(12) United States Patent
Poth et al.

(10) Patent No.: US 9,796,764 B2
(45) Date of Patent: Oct. 24, 2017

(54) CYCLOTIDE GENES IN THE FABACEAE PLANT FAMILY

(75) Inventors: Aaron G. Poth, St. Lucia (AU);
Michelle Colgrave, Campbell (AU);
Russell Lyons, Campbell (AU); David Craik, St. Lucia (AU)

(73) Assignees: The University of Queensland, St. Lucia (AU); Commonwealth Scientific and Industrial Research Organisation, Campbell (AU)

( * ) Notice: Subject to any disclaimer, the term of this patent is extended or adjusted under 35 U.S.C. 154(b) by 803 days.

(21) Appl. No.: 13/428,860

(22) Filed: Mar. 23, 2012

(65) Prior Publication Data
US 2012/0244575 A1 Sep. 27, 2012

Related U.S. Application Data

(60) Provisional application No. 61/466,888, filed on Mar. 23, 2011.

(51) Int. Cl.
*C07K 14/415* (2006.01)

(52) U.S. Cl.
CPC .................................. *C07K 14/415* (2013.01)

(58) Field of Classification Search
None
See application file for complete search history.

(56) References Cited

U.S. PATENT DOCUMENTS

| | | | |
|---|---|---|---|
| 5,990,385 A * | 11/1999 | Vezina et al. | 800/278 |
| 7,960,340 B2 * | 6/2011 | Craik | C07K 14/001 514/17.4 |
| 2003/0158096 A1 | 8/2003 | Craik | |
| 2006/0035819 A1 * | 2/2006 | Craik et al. | 514/9 |
| 2006/0156439 A1 * | 7/2006 | Diehn et al. | 800/287 |

FOREIGN PATENT DOCUMENTS

| | | |
|---|---|---|
| WO | 01/27147 | 4/2001 |
| WO | 01/34829 | 5/2007 |

OTHER PUBLICATIONS

Daly et al (Advanced Drug Delivery Reviews, 61, pp. 918-930, 2009).*
Gillon et al (Plant Journal, 53, pp. 505-515, 2008).*
Stoger et al (Current Opinion in Biotechnology, 16(2), pp. 167-173, 2005).*
GenEmbl AJ276882 (Published Mar. 2000).*
Austin et al (ChemBioChem, 2009, 10: 2663-2670).*
Simonsen et al (J. Bio. Chem., 2008, 283: 9805-9813; cited on IDS).*
Gunasekera et al (J. Med. Chem., 2008, 51: 7697-7704; cited on IDS).*
Abe et al. "Asparaginyl endopeptidase of jack bean seeds. Purification, characterization, and high utility in protein sequence analysis," J Biol Chem, 268: 3525-3529, 1993.
Barbeta et al. "Plant cyclotides disrupt epithelial cells in the midgut of lepidopteran larvae," PNAS, 105: 1221-1225, 2008.
Bendsten et al. "Improved prediction of signal peptides: SignalP 3.0," J Mol Biol, 340: 783-795, 2004.
Boscariol et al. "The use of the PMI/mannose selection system to recover transgenic sweet orange plants (*Citrus sinensis* L. Osbeck)," Plant Cell Rep, 22: 122-128, 2003.
Brunger et al. "Version 1.2 of the Crystallography and NMR system," Nat Protoc, 2: 2728-2733, 2007.
Camarero et al. "Biosynthesis of a fully functional cyclotide inside living bacterial cells," Chem Biochem, 8: 1363-1366, 2007.
Carrington et al. "Polypeptide ligation occurs during post-translational modification of concanavalin A.," Nature, 313: 64-67, 1985.
Chiche et al. "Squash inhibitors: from structural motifs to macrocyclic knottins," Curr Protein Pept Sci, 5: 341-349, 2004.
Chowrira et al. "Transgenic grain legumes obtained by in planta electroporation-mediated gene transfe," Mol Biotechnol, 5: 85-96, 1996.
Colgrave et al. "A new "era" for cyclotide sequencing," Biopolymers, 94: 592-601, 2010.
Colgrave et al. "Anthelmintic activity of cyclotides: In vitro studies with canine and human hookworms," Acta Trop, 109: 163-166, 2009.
Colgrave et al. "Cyclotide interactions with the nematode external surface," Antimicrob Agents Chemother, 54: 2160-2166, 2010.
Colgrave et al. "Cyclotides: natural, circular plant peptides that possess significant activity against gastrointestinal nematode parasites of sheep," Biochemistry, 47: 5581-5589, 2008.
Colgrave et al. "The anthelmintic activity of the cyclotides: natural variants with enhanced activity," Chem BioChem, 9: 1939-1945, 2008.
Colgrave et al. "Thermal, chemical, and enzymatic stability of the cyclotide kalata B1: the importance of the cyclic cystine knot," Biochemistry, 43: 5965-5975, 2004.
Collinge et al. "Engineering pathogen resistance in crop plants: current trends and future prospects," Ann Rev Phytopathol, 48: 269-291, 2010.
Cortese et al. "Identification of biologically active peptides using random libraries displayed on phage," Curr Opin Biotech, 6: 73-80, 1995.
Craik et al. "Chemistry. Seamless proteins tie up their loose ends," Science, 311: 1563-1564, 2006.
Craik et al. "Plant cyclotides: A unique family of cyclic and knotted proteins that defines the cyclic cystine knot structural motif," J Mol Biol, 294, 1327-1336, 1999.
Craik et al. "The cystine knot motif in toxins and implications for drug design," Toxicon, 39: 43-60, 2001.
Crooks et al. "WebLogo: a sequence logo generator," Genome Res, 14: 1188-1190, 2004.

(Continued)

*Primary Examiner* — Elizabeth McElwain
*Assistant Examiner* — Stephen Uyeno
(74) *Attorney, Agent, or Firm* — Casimir Jones, S.C.

(57) ABSTRACT

The present invention relates to cyclotides and cyclotide-encoding genes from the Fabaceae plant family, and to the expression of cyclotides in Fabaceae. The present invention further relates to isolated nucleic acids configured to express cyclotides comprising heterologous peptide grafts in plants of the Fabaceae family.

11 Claims, 37 Drawing Sheets

(56) References Cited

OTHER PUBLICATIONS

Da Silva et al. "Molecular requirements for the insecticidal activity of the plant peptide pea albumin 1 subunit b (PA1b)," J Biol Chem, 285: 32689-32694, 2010.
Daly et al. "Chemical synthesis and folding pathways of large cyclic polypeptides: studies of the cystine knot polypeptide kalata B1," Biochemistry, 38: 10606-10614, 1999.
Defreitas et al. "Structural characterization and promoter activity analysis of the gamma-kafirin gene from sorghum," Mol Gen Genet, 245: 177-186, 1994.
Dunwell et al. "Transgenic approaches to crop improvement," J Exp Bot, 57: 487-496, 2000.
Dutton et al. "Conserved structural and sequence elements implicated in the processing of gene-encoded circular proteins," J Biol Chem, 279: 46858-46867, 2004.
Ealing et al. "Expression of the pea albumin 1 gene in transgenic white clover and tobacco," Transgenic Res, 3: 344-354, 1994.
Eapen et al. "Cultivar dependence of transformation rates in moth bean after co-cultivation of protoplasts with Agrobacterium tumefaciens," TAG: Theor Appl Genet, 75: 207-210, 1987.
Eapen, "Advances in development of transgenic pulse crops," Biotechnol Adv, 26: 162-168, 2008.
Emanuelsson et al. "Locating proteins in the cell using TargetP, SignalP and related tools," Nature Protocols, 2: 953-971, 2007.
Fantz et al. "Ethnobotany of Clitoria (Leguminosae)," Econ Bot, 45: 511-520, 1991.
Gao et al. "Synthesis and disulfide bond connectivity-activity studies of a kalata B1-inspired cyclopeptide against dengue NS2B-NS3 protease," Bioorg Med Chem, 18: 1331-1336, 2010.
Gillon et al. "Biosynthesis of circular proteins in plants," Plant J, 53: 505-515, 2008.
Gran et al. "1. Gran L: An oxytocic principle found in Oldenlandia affinis DC.," Medd Nor Farm Selsk, 12: 173-180, 1970.
Gran et al. "Oxytocic principles of Oldenlandia affinis," Lloydia the Journal of Natural Products, 36: 174-178, 1973.
Gruber et al. "Distribution and evolution of circular miniproteins in flowering plants," Plant Cell, 20: 2471-2483, 2008.
Gunasekera et al. "Engineering stabilized vascular endothelial growth factor-A antagonists: synthesis, structural characterization, and bioactivity of grafted analogues of cyclotides," J Med Chem, 51: 7697-7704, 2008.
Guntert, "Automated NMR structure calculation with CYANA," Methods Mol Biol, 278: 353-378, 2004.
Gustafson et al. "Circulins A and B. Novel human immunodeficiency virus (HIV)-inhibitory macrocyclic peptides from the tropical tree Chassalia parvifolia.," J Am Chem Soc, 116: 9337-9338, 1994.
Gustafson et al. "New circulin macrocyclic polypeptides from Chassalia parvifolia," J Nat Prod, 63: 176-178, 2000.
Hajdukiewicz et al. "The small, versatile pPZP family of Agrobacterium binary vectors for plant transformation," Plant Mol Biol, 25: 989-994, 1994.
Halfon et al. "Autocatalytic activation of human legumain at aspartic acid residues," FEBS Lett, 438, 114-118, 1998.
Hernandez et al. "Squash trypsin inhibitors from Momordica cochinchinensis exhibit an atypical macrocyclic structure," Biochemistry, 39: 5722-5730, 2000.
Hernandez-Garcia et al. "A soybean (Glycine max) polyubiquitin promoter gives strong constitutive expression in transgenic soybean," Plant Cell Rep, 28: 837-849, 2009.
Huang et al. "Lysine-scanning mutagenesis reveals an amendable face of the cyclotide kalata B1 for the optimization of nematocidal activity," J Biol Chem, 285(14):10797-10805, 2010.
Huang et al. "The biological activity of the prototypic cyclotide kalata b1 is modulated by the formation of multimeric pores," J Biol Chem, 284: 20699-20707, 2009.
Hutchinson et al. "PROMOTIF—a program to identify and analyze structural motifs in proteins," Protein Sci, 5: 212-220, 1996.

Indurker et al. "Genetic transformation of chickpea (Cicer arietinum L.) with insecticidal crystal protein gene using particle gun bombardment," Plant Cell Rep, 26: 755-763, 2007.
Ireland et al. "A novel suite of cyclotides from Viola odorata: sequence variation and the implications for structure, function and stability," Biochem J, 400: 1-12, 2006.
Jennings et al. "Biosynthesis and insecticidal properties of plant cyclotides: the cyclic knotted proteins from Oldenlandia affinis," PNAS, 98: 10614-10619, 2001.
Kaas et al. "Analysis and classification of circular proteins in CyBase," Peptide Sci, 94: 584-591, 2010.
Kaas et al. "Conopeptide characterization and classifications: An analysis using ConoServer," Toxicon, 55: 2010 1491-1509, 2010.
Kamble et al. "A protocol for efficient biolistic transformation of mothbean Vigna aconitifolia L. Jacq. Marechal," Plant Mol Biol Reporter, 21: 457a-j, 2003.
Koenning et al. "Survey of crop losses in response to phytoparasitic nematodes in the United States for 1994," J Nematol, 31: 587-618, 1999.
Kohler et al. "Stable transformation of moth bean Vigna aconitifolia via direct gene transfer," Plant Cell Rep, 6: 1987 313-317, 1987.
Kohler et al. "Influence of plant cultivar and plasmid-DNA on transformation rates in tobacco and moth bean," Plant Sci, 53: 87-91, 1987.
Komari et al. "Binary vectors and super-binary vectors," Methods Mol Biol, 343: 15-42, 2006.
Koradi et al. "MOLMOL: a program for display and analysis of macromolecular structures," J Mol Graph, 14: 29-32, 1996.
Krishnamurthy et al. "Agrobacterium mediated transformation of chickpea ( Cicer arietinum L.) embryo axes," Plant Cell Rep, 19: 235-240, 2000.
Laskowski et al. "Aqua and Procheck-NMR: programs for checking the quality of protein structures solved by NMR.," J Biomol NMR, 8: 477-486, 1996.
Min et al. "In vitro splicing of concanavalin A is catalyzed by asparaginyl endopeptidase," Nat Struct Biol, 1: 502-504, 1994.
Mukherjee et al. "The Ayurvedic medicine Clitoria ternatea—from traditional use to scientific assessment.," J Ethnopharmacol, 120: 291-301, 2008.
Mulvenna et al. "Discovery, structural determination, and putative processing of the precursor protein that produces the cyclic trypsin inhibitor sunflower trypsin inhibitor 1," J Biol Chem, 280: 32245-32253, 2005.
Nguyen et al. "Discovery and characterization of novel cyclotides originated from chimeric precursors consisting of albumin-1 chain a and cyclotide domains in the Fabaceae family," J Biol Chem, 286(27): 24275-24287, 2011.
Opperman et al. "Sequence and genetic map of Meloidogyne hapla: A compact nematode genome for plant parasitism," PNAS, 105: 14802-14807, 2008.
Pallaghy et al. "A common structural motif incorporating a cystine knot and a triple-stranded beta-sheet in toxic and inhibitory polypeptides," Protein Sci, 3: 1833-1839, 1994.
Poth et al. "Discovery of cyclotides in the fabaceae plant family provides new insights into the cyclization, evolution, and distribution of circular proteins," ACS Chem Biol, 6: 345-355, 2011.
Qin et al. "Identification of candidates for cyclotide biosynthesis and cyclisation by expressed sequence tag analysis of Oldenlandia affinis," BMC Genomics, 11: 111, 2010.
Rogers et al. "[15] Improved vectors for plant transformation: Expression cassette vectors and new selectable markers," Methods Enzymol, 153: 253-277, 1987.
Rosengran et al. "Twists, knots, and rings in proteins. Structural definition of the cyclotide framework," J Biol Chem, 278: 8606-8616, 2003.
Saether et al. "Elucidation of the primary and three-dimensional structure of the uterotonic polypeptide kalata B1," Biochemistry, 34: 4147-4158, 1995.
Saska et al. "An asparaginyl endopeptidase mediates in vivo protein backbone cyclization," J Biol Chem, 282:29721-29728, 2007.
Saska et al. "Quantitative analysis of backbone-cyclised peptides in plants," J Chromatogr B, 872: 107-114, 2008.

(56) References Cited

OTHER PUBLICATIONS

Sharma et al. "Agrobacterium-mediated production of transgenic pigeonpea (*Cajanus cajan* L. Millsp.) expressing the synthetic Bt cry1Ab gene," In Vitro Cell Dev Biol Plant, 42: 165-173, 2006.

Simonsen et al. "Alanine scanning mutagenesis of the prototypic cyclotide reveals a cluster of residues essential for bioactivity," J Biol Chem, 283: 9805-9813, 2008.

Suto et al. "Crystal structures of novel vascular endothelial growth factors (VEGF) from snake venoms: insight into selective VEGF binding to kinase insert domain-containing receptor but not to fms-like tyrosine kinase-1," J Biol Chem, 290: 2126-2131, 2005.

Svangard et al. "Mechanism of action of cytotoxic cyclotides: cycloviolacin O2 disrupts lipid membranes," J Nat Prod, 70: 643-647, 2007.

Tam et al. "An unusual structural motif of antimicrobial peptides containing end-to-end macrocycle and cystine-knot disulfides," PNAS, 96: 8913-8918, 1999.

Tang et al. "A cyclic antimicrobial peptide produced in primate leukocytes by the ligation of two truncated alpha-defensins," Science, 286, 498-502, 1999.

Thongyoo et al. "Chemical and biomimetic total syntheses of natural and engineered MCoTI cyclotides," Org Biomol Chem, 6: 1462-1470, 2008.

Thongyoo et al. "Potent inhibitors of beta-tryptase and human leukocyte elastase based on the MCoTI-II scaffold," J Med Chem, 52: 6197-6200, 2009.

Trabi et al. "Tissue-specific expression of head-to-tail cyclized miniproteins in Violaceae and structure determination of the root cyclotide Viola hederacea root cyclotide1," Plant Cell, 16: 2204-2216, 2004.

Valvekens et al. "Agrobacterium tumefaciens-mediated transformation of Arabidopsis thaliana root explants by using kanamycin selection," PNAS, 85: 5536-5540, 1988.

Wright et al. "Nonenzymatic deamidation of asparaginyl and glutaminyl residues in proteins," Crit Rev Biochem Mol Biol, 26: 1-52, 1991.

\* cited by examiner

FIG. 9

```
CLUSTAL 2.1 multiple sequence alignment

CterB           G-VPCAESCVWIPCTVTALLGCSCKDKVCYLN 31 (SEQ ID NO:8)
CterC           G-VPCAESCVWIPCTVTALLGCSCKDKVCYLD 31 (SEQ ID NO:9)
CterE           G-IPCAESCVWIPCTVTALLGCSCKDKVCYLD 31 (SEQ ID NO:10)
CterD           G-IPCAESCVWIPCTVTALLGCSCKDKVCYLN 31 (SEQ ID NO:11)
CterR           G-IPCGESCVFIPCTVTALLGCSCKDKVCYKN 31 (SEQ ID NO:12)
CterA           GVIPCGESCVFIPC-ISTVIGCSCKNKVCYPN 31 (SEQ ID NO:7)
CterQ           G-IPCGESCVFIPC-ISTVIGCSCKNKVCYPN 30 (SEQ ID NO:14)
CterG           G-LPCGESCVFIPC-ITTVVGCSCKNKVCYNN 30 (SEQ ID NO:15)
CterH           G-LPCGESCVFIPC-ITTVVGCSCKNKVCYND 30 (SEQ ID NO:16)
CterK           H-EPCGESCVFIPC-ITTVVGCSCKNKVCYN- 29 (SEQ ID NO:17)
CterL           H-EPCGESCVFIPC-ITTVVGCSCKNKVCYD- 29 (SEQ ID NO:18)
CterF           G-IPCGESCVFIPC-ISSVVGCSCKSKVCYLD 30 (SEQ ID NO:19)
CterP           G-IPCGESCVFIPC-ITAAIGCSCKSKVCYPN 30 (SEQ ID NO:20)
PsyleF          GVIPCGESCVFIPC-ITAAVGCSCKNKVCYPD 31 (SEQ ID NO:21)
CterI           GTVPCGESCVFIPC-ITGIAGCSCKNKVCYIN 31 (SEQ ID NO:22)
CterJ           GTVPCGESCVFIPC-ITGIAGCSCKNKVCYID 31 (SEQ ID NO:23)
CterO           G-IPCGESCVFIPC-ITGIAGCSCKSKVCYRN 30 (SEQ ID NO:24)
CterM           GLPTCGETCTLGTC---YVPDCSCSWPICHKN 29 (SEQ ID NO:25)
CterN           GSAFCGETCVLGTC---YTPDCSCTALVCLKN 29 (SEQ ID NO:26)
                  *.*:*.  .*      .***.  :*
```

FIG. 10

```
     (SEQ ID NO:27)
  1  ACAGCAAAAGAGTAATTCCTTATTTTCATCAACTATGGCTTACGTTAGACTTACTTCTCT  60
                                   (SEQ ID NO:28) M  A  Y  V  R  L  T  S  L
 61  TGCCGTTCTCTTCTTCCTTGCTGCTTCCGTTATGAAGACAGAAGGAGGACTTcctacatg 120
      A  V  L  F  F  L  A  A  S  V  M  K  T  E  G  G  L  P  T  C
121  cggagaaacttgTACCCTGGGGACATGTTATGTGCCAGATTGTTCATGTTCATGGCCAAT 180
      G  E  T  C  L  G  T  C  Y  V  P  D  C  S  C  S  W  P  I
181  TTGCATGAAAAATCATATCATTGCAGCTAATGCAAAAACAGTGAATGAACATCGTCTCTT 240
      C  M  K  N  H  I  I  A  A  N  A  K  T  V  N  E  H  R  L  L
241  ATGTACATCTCATGAAGACTGTTTTAAGAAAGGCACTGGAAACTATTGTGCTTCTTTTCC 300
      C  T  S  H  E  D  C  F  K  K  G  T  G  N  Y  C  A  S  F  P
301  CGATTCTAACATCCATTTTGGTTGGTGTTTCCATGCTGAATCTGAAGGATATTTGTTGAA 360
      D  S  N  I  H  F  G  W  C  F  H  A  E  S  E  G  Y  L  L  K
361  AGACTTTATGAATATGTCAAAGGATGACTTAAAGATGCCTTTGGAAAGTACCAACTAAAA 420
      D  F  M  N  M  S  K  D  D  L  K  M  P  L  E  S  T  N  .
421  GTGATCATGTATGATACATCTATAAATTTAAATAAATGCTATGAAGCATATCTACTATTT 480
481  TAAATAAAAAAAAAAAAAAAAAAAAAAAAAAAAAA 514
```

FIG. 11 kB1 = SEQ ID NO: 29
kB3 & kB6 = SEQ ID NO: 30
kB2 = SEQ ID NO: 31
Q39837 Glycine max albumin-1 = SEQ ID NO: 32
P62929 Pisum sativum albumin-1 = SEQ ID NO: 33
Cter M = SEQ ID NO: 28

FIG. 13

Alignment of Precursor Polypeptides

A: Cter M (SEQ ID NO: 28)
B: Ct_Novel_Cyclotide3 (SEQ ID NO: 34)
C: Ct_Novel_Cyclotide1 (SEQ ID NO: 35)
D: Ct_Novel_Cyclotide2 (SEQ ID NO: 36)

```
A:  MAYVRLTSLAVLFFLAASVMKTEGGLFTCGETCTLGTCYVPDCSCSWPICMKNHIIAANAKTVNEHRLLCTSHEDCFFKGTGNYCASFPDSNIHFGWCFRAESEGYLLKOFMNMSKDLKMPLESTN  127
B:  ------------------------------VQGECTFGCSCDWPICKKNHIIATNAKTVNQHRLLCESHEDCFKKGTGNYCAFFPDSDVHFGWCFYAESDGVLSKDFPYMSKDNLKMPMTIIN----  94
C:  ------------------------------ITAAIGCSCKSKVCYRNHVIAAEAKTMDDHRLLCQSHEDCITKGTGNFCAPFPDQDIKYGWCFRAESEGFLLKDHLKMS------------ITN----  82
D:  ------------------------------ITGAIGCSCKSKVCYRNHVIAAEAKTMDDRHLLCQSHEDCITKGTGNFCAPFPDQDIKYGWCFRAESEGFMLKDHLKMS------------ITN----  82
                                  .  **.  .:  *  :*****:::****:.*****  ***:*:::****:******:.  ***  ****:*:  **;:**
```

FIG. 17
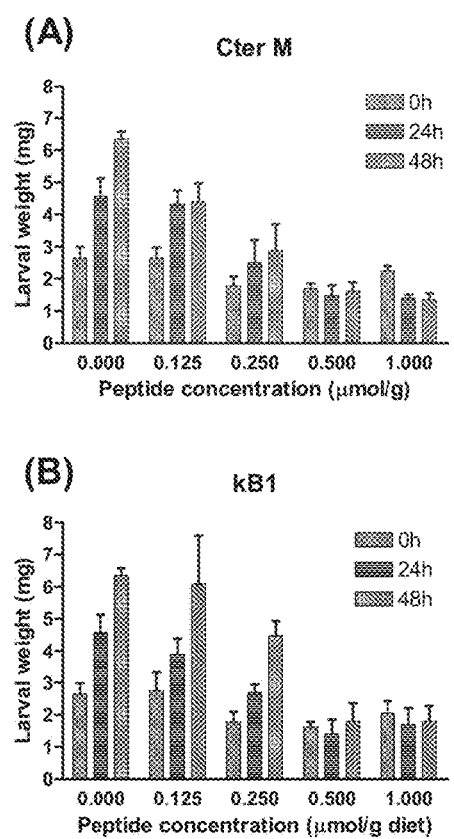
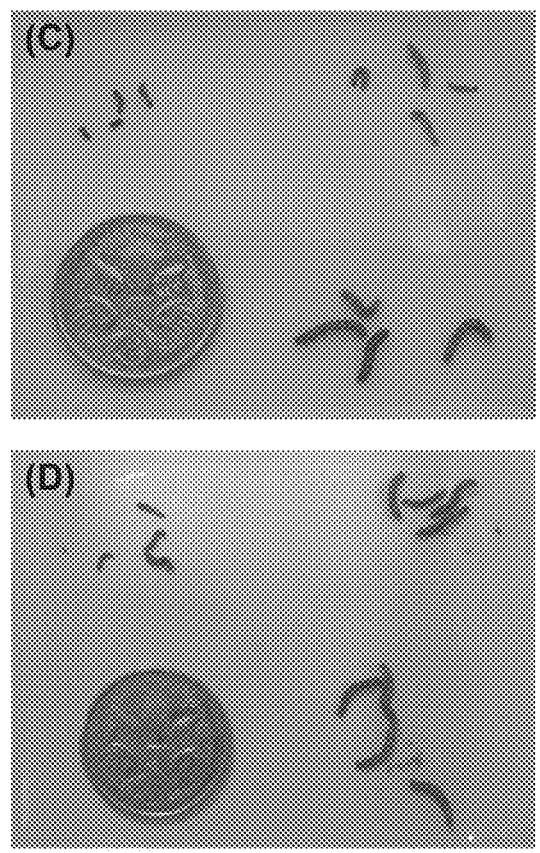

*Oldenlandia affinis* kalata B1 SignalP analysis

*Pisum sativum* Albumin-1 SignalP Analysis.

*Medicago truncatula* Albumin-1 SignalP analysis.

*Phaseolus vulgaris* Albumin-1 SignalP analysis.

*Glycine max* Albumin-1 SignalP analysis.

FIG. 21
(A)
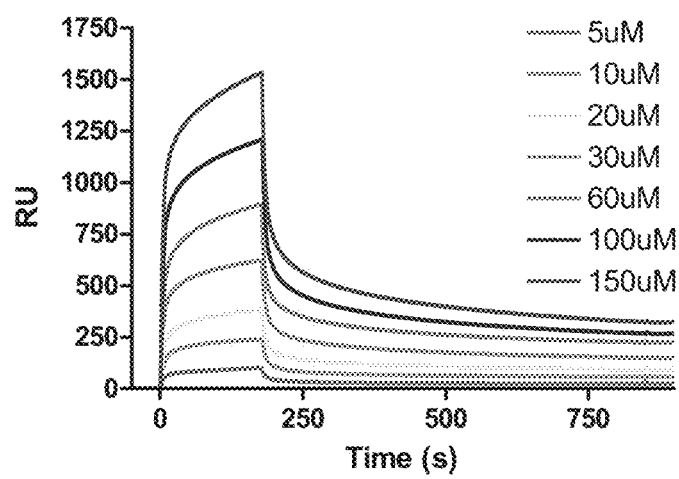
(B)
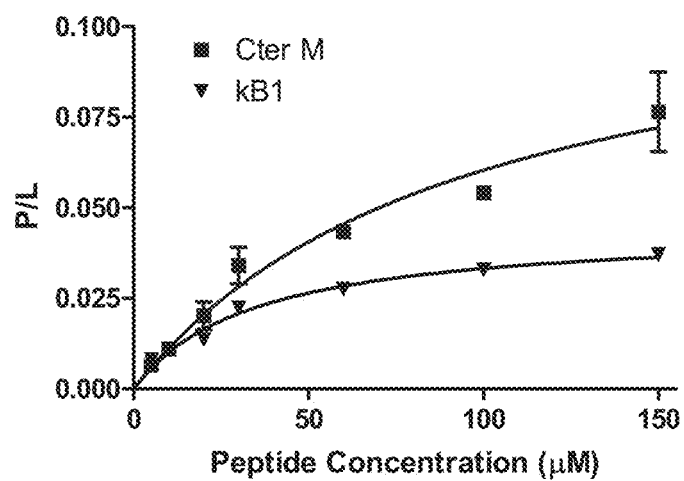

CYCLOTIDE GENES IN THE FABACEAE PLANT FAMILY

This application claims priority to U.S. Provisional Application Ser. No. 61/466,888, filed Mar. 23, 2011, which is incorporated herein by reference in its entirety.

FIELD OF THE INVENTION

The present invention relates to cyclotides and cyclotide genes from the Fabaceae plant family, and to the expression of cyclotides in Fabaceae. The present invention further relates to isolated nucleic acids configured to express cyclotides comprising heterologous peptide grafts in plants of the Fabaceae family.

BACKGROUND OF THE INVENTION

Cyclotides are a topologically unique family of plant proteins that are exceptionally stable (Craik, D. J., et al., (1999) *J. Mol. Biol.* 294, 1327-1336). They comprise ~30 amino acids arranged in a head-to-tail cyclized peptide backbone that additionally is restrained by a cystine knot motif associated with six conserved cysteine residues. The cystine knot (Pallaghy, P. K., Nielsen, K. J., Craik, D. J. & Norton, R. S. (1994) *Protein Sci.* 3, 1833-1839) is built from two disulfide bonds and their connecting backbone segments forming an internal ring in the structure that is threaded by the third disulfide bond to form an interlocking and cross braced structure (FIG. 1). Superimposed on this cystine knot core motif are a well-defined β-sheet and a series of turns displaying short surface-exposed loops.

Cyclotides express a diversity of peptide sequences within their backbone loops and have a broad range of biological activities, including uterotonic (Gran, L. (1970) *Medd. Nor. Farm. Selsk.* 12, 173-180), anti-HIV (Gustafson, K. R., Sowder, R. C. I., Henderson, L. E., Parsons, I. C., Kashman, Y., Cardellina, J. H. I., McMahon, J. B., Buckheit, R. W. J., Pannell, L. K. & Boyd, M. R. (1994) *J. Am. Chem. Soc.* 116, 9337-9338), antimicrobial (Tam, J. P., Lu, Y. A., Yang, J. L. & Chiu, K. W. (1999) *Proceedings of the National Academy of Sciences of the United States of America* 96, 8913-8918), and anticancer activities (Svångard, E., Burman, R., Gunasekera, S., Lovborg, H., Gullbo, J. & Göransson, U. (2007) *J Nat Prod* 70, 643-7). They are thus of great interest for pharmaceutical applications. Some plants from which they are derived are used in indigenous medicines, including kalata-kalata, a tea from the plant *Oldenlandia affinis* that is used for accelerating childbirth in Africa that contains the prototypic cyclotide kalata B1 (Gran, L. (1973) *Lloydia* 36, 174-178). This ethnobotanical use and more recent biophysical studies (Colgrave, M. L. & Craik, D. J. (2004) *Biochemistry* 43, 5965-5975) illustrate the remarkable stability of cyclotides, i.e., they survive boiling and ingestion, observations unprecedented for conventional peptides. Their exceptional stability means that they have attracted attention as potential templates in peptide-based drug design applications (Craik, D. J. (2006) *Science* 311, 1563-1564). In particular, the grafting of bioactive peptide sequences into a cyclotide framework offers the promise of a new approach to stabilize peptide-based therapeutics, thereby overcoming one of the major limitations on the use of peptides as drugs. Chemical (Daly, N. L., Love, S., Alewood, P. F. & Craik, D. J. (1999) *Biochemistry* 38, 10606-14; Tam, J. P. & Lu, Y.-A. (1998) *Protein Sci.* 7, 1583-1592), chemo-enzymatic (Thongyoo, P., Roque-Rosell, N., Leatherbarrow, R. J. & Tate, E. W. (2008) *Org Biomol Chem* 6, 1462-1470), and recombinant (Camarero, J. A., Kimura, R. H., Woo, Y.-H., Shekhtman, A. & Cantor, J. (2007) *ChemBioChem* 8, 1363-1366) approaches to the synthesis of cyclotides have been developed, thus facilitating these pharmaceutical applications. See also WO 01/27147 to Craik, et al, and WO 01/34829 to Craik, et al., each incorporated herein by reference.

One issue with expressing cyclotides in different host plants is ensuring that the host plant has the necessary cellular machinery to process the expressed polypeptides to produce mature cyclic molecules. One approach is to identify host plant families that produce naturally occurring cyclotides, and to adapt the natural genes to facilitate the expression of foreign or engineered cyclotides (e.g., cyclotides from other plant families, or cyclotides engineered to contain one or more grafted peptide sequences). Until recently cyclotides had been found only in the Rubiaceae (coffee) and Violaceae (violet) plant families (Kaas, Q., Westermann, J. C. & Craik, D. J. (2010) *Toxicon* 55, 1491-509), apart from two atypical members in the Cucurbitaceae (cucurbit) family (Chiche, L., Heitz, A., Gelly, J. C., Gracy, J., Chau, P. T., Ha, P. T., Hernandez, J. F. & Le-Nguyen, D. (2004) *Curr Protein Pept Sci* 5, 341-349). Cyclotides from the Rubiaceae and Violaceae are biosynthesized via processing from dedicated precursor proteins encoded by multi-domain genes which contain one, two or three cyclotide domains (Dutton, J. L., Renda, R. F., Waine, C., Clark, R. J., Daly, N. L., Jennings, C. V., Anderson, M. A. & Craik, D. J. (2004) *J. Biol. Chem.* 279, 46858-46867).

There remains a need for expression systems configured to express foreign and modified cyclotides in additional plant families.

SUMMARY OF THE INVENTION

The present invention provides systems and methods for producing cyclotides in plants of the Fabaceae family. In some embodiments, the present invention provides isolated genes encoding cyclotides of the Fabaceae family, while in some embodiments, the present invention provides expression systems making use of Fabaceae cyclotide genetic framework for the expression of foreign or modified cyclotides in plants of the Fabaceae family.

In some embodiments, the present invention provides an isolated nucleic acid molecule comprising a sequence of nucleotides encoding a precursor form of a cystine knot polypeptide (e.g., a linear polypeptide), wherein the amino acid sequence of the precursor form comprises a signal peptide, a cystine knot polypeptide, and a non-cystine knot polypeptide, wherein the cystine knot polypeptide in its mature form comprises the structure:

$$C_1(X_1 \ldots X_a)C_2(X^I_1 \ldots X^I_b)C_3(X^{II}_1 \ldots X^{II}_c)C_4(X^{III}_1 \ldots X^{III}_d)C_5(X^{IV}_1 \ldots X^{IV}_e)C_6(X^V_1 \ldots X^V_f);$$

loop 1 loop 2 loop 3 loop 4 loop 5 loop 6 wherein $C_1$ to $C_6$ are cysteine residues;
wherein each of $C_1$ and $C_4$, $C_2$ and $C_5$, and $C_3$ and $C_6$ are connected by a disulfide bond to form a cystine knot;
wherein each X represents an amino acid residue in a loop, wherein the amino acid residues may be the same or different;
wherein d is about 1-2;
wherein for a, b, c, e, and f, and
i) a may be any number from 3-10, and
ii) b, c, e, and f may be any number from 1 to 20.

In certain embodiments, in the isolated nucleic acid molecule described above, a is from about 3 to 6, b is from about 3 to about 5, c is from about 2 to about 7, e is from about 3 to about 6 and f is from about 4 to about 9. In some embodiments, a is about 3, b is about 4, c is from about 4 to about 7, d is about 1, e is about 4 or 5 and f is from about 4 to about 7.

In some embodiments, in the precursor form of a cystine knot polypeptide, the sequence of at least one cystine knot polypeptide comprises on at least one end an amino acid triplet selected from the group consisting of GLP, GIP, and SLP. In certain preferred embodiments, in the cyclic form of the cystine knot polypeptide, loop 6 of the encoded polypeptide has an amino acid sequence selected from the group consisting of YRNGVIP (SEQ ID NO:110), YLNGVIP (SEQ ID NO:111), YLDGVP (SEQ ID NO:112), YLNGIP (SEQ ID NO:113), YLDGIP (SEQ ID NO:114), YLNGLP (SEQ ID NO:115), YNNGLP (SEQ ID NO:116), YNDGLP (SEQ ID NO:117), YINGTVP (SEQ ID NO:118), YIDGTVP (SEQ ID NO:119), YNHEP (SEQ ID NO:120), YDHEP (SEQ ID NO:121), LKNGSAF (SEQ ID NO:122), MKNGLP (SEQ ID NO:123), YRNGIP (SEQ ID NO:124), YKNGIP (SEQ ID NO:125, and YRDGVIP (SEQ ID NO:126).

In some embodiments, the cystine knot polypeptide portion of said linear precursor comprises the structure:

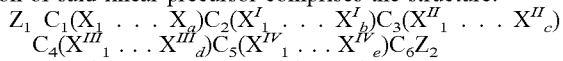

wherein $C_1$ to $C_6$ are cysteine residues;
wherein each of $C_1$ and $C_4$, $C_2$ and $C_5$, and $C_3$ and $C_6$ are connected by a disulfide bond to form a cystine knot,
wherein each X represents an amino acid residue in a loop, wherein said amino acid residues may be the same or different;
wherein d is about 1-2;
wherein for a, b, c, and e, and
i) a may be any number from 3-10, and
ii) b, c, and e may be any number from 1 to 20 and
wherein $Z_1$ is GVP, GIP, GVIP, GLP, HEP, GTVP, or GSA, and $Z_2$ is YLN, YLD, YKN, YRN, YNN, YND, TN, TD, YRD, YIN, MKN, or LKN.

In some embodiments of the encoded precursor form of the cystine knot polypeptide, a linker peptide comprising two or more amino acids connects the non-cystine knot polypeptide with the C-terminal amino acid of the sequence that forms the mature form of the cystine knot polypeptide. The non-cystine knot polypeptide may comprise a protein associated with a different function in an organism (e.g., a protein such as albumin, known to have functions that are not typically associated with or requiring the presence of a cyclic cystine knot peptide). In certain preferred embodiments, the non-cystine knot polypeptide comprises an albumin or albumin-like polypeptide, and the CCK portion replaces a portion of a typical albumin polypeptide sequence. In some particularly preferred embodiment, the albumin polypeptide comprises an albumin-1 a-chain and the CCK portion replaces some or, all of the b-chain portion of the albumin-1 polypeptide.

As used herein, the "signal" peptide generally refers to an endoplasmic reticulum (ER) signal sequence, typically of about 24 amino acids. (Emanuelsson, O., Brunak, S., von Heijne, G., Nielsen H. (2007) *Nature Protocols*, 2, 953-971) In certain embodiments, in the isolated nucleic acid molecule described above, in the amino acid sequence of the precursor form the signal peptide is contiguous with the N-terminal amino acid of the sequence that makes up the mature form of the cystine knot polypeptide. In particularly preferred embodiments, the isolated nucleic acid molecule comprising a sequence encoding a precursor form of a cystine knot polypeptide is from a plant belong to the family Fabaceae. In certain particularly preferred embodiments, the nucleic acid sequence encoding the precursor form of a cystine knot polypeptide is from *Clitoria ternatea*. In some embodiments, the signal peptide is encoded by a nucleotide sequence comprising ATGGCTTACGTTAGACTTACT-TCTCTTGCCGTTCTCTTCTTCCTTGCTGCTTCCGTT ATGAAGACAGAAGGA (JF501210) (SEQ ID NO:127), while in some embodiments, the signal peptide is encoded by a nucleic acid sequence selected from SEQ ID NOS:150, 152, 154, 156, 158, and 160. In some embodiments, the isolated nucleic acid encodes a signal peptide comprising the amino acid sequence MAYVRLTSLAVLFFLAASVMK-TEG (JF501210) (SEQ ID NO:128), while in some embodiments, the isolated nucleic acid encodes a signal peptide having an amino acid sequence selected from SEQ ID NOS:151, 153, 155, 157, 159 and 161.

In some embodiments, the present invention provides an isolated nucleic acid molecule encoding a proteinaceous molecule having a cyclic cystine knot backbone and a defined biological activity, comprising a sequence of nucleotides encoding a precursor form of a cystine knot polypeptide operably linked to a promoter, wherein the amino acid sequence of the precursor form comprises a signal peptide, a cystine knot polypeptide and a non-cystine knot polypeptide, wherein the cystine knot polypeptide in its mature form comprises the structure:

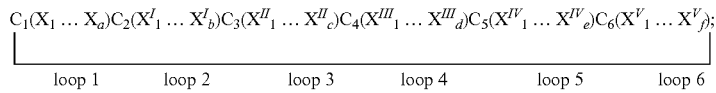

wherein $C_1$ to $C_6$ are cysteine residues and each of $C_1$ and $C_4$, $C_2$ and $C_5$, and $C_3$ and $C_6$ are connected by a disulfide bond to form a cystine knot, and wherein each X represents an amino acid residue in a loop, which may be the same or different. In certain preferred embodiments, d is about 1-2 and one or more of loops 1, 2, 3, 5 or 6 have an amino acid sequence comprising the sequence of a heterologous peptide comprising a plurality of contiguous amino acids and having a defined biological activity, the peptide being generally about 2 to 30 amino acid residues, such that any loop comprising the sequence of the peptide comprises 2 to about 30 amino acids, and such that for any of loops 1, 2, 3, 5, or 6 that do not contain the sequence of the peptide, a, b, c, e, and f, may be the same or different, and a may be any number from 3-10, and b, c, e, and f may be any number from 1 to 20.

In some embodiments of the isolated nucleic acid described above, the amino acid sequence of the heterologous peptide comprises a portion of an amino acid sequence of a larger protein, wherein the heterologous peptide confers the defined biological activity on the larger protein.

In some embodiments of the isolated nucleic acid described above, for any of loops 1, 2, 3, 4, 5, or 6 that do not contain the sequence of the heterologous peptide, a is from about 3 to 6, b is from about 3 to about 5, c is from about 2 to about 7, d is about 1 to 2, e is from about 3 to about 6 and f is from about 4 to about 9. In some preferred embodiments, a is about 3 and d is about 1, and for any of loops 2, 3, 5, or 6 that do not contain the sequence of the heterologous peptide, b is about 4, c is from about 4 to about 7, e is about 4 or 5 and f is from about 4 to about 7. In certain particularly preferred embodiments, a is about 6 and d is about 1, and for any of loops 2, 3, 5, or 6 that do not contain the sequence of the heterologous peptide, b is about 5, c is about 3, e is from about 5 and f is from about 8.

In some embodiments, any loop comprising the sequence of the heterologous peptide comprises 2 to about 20 amino acids, more preferably 2 to about 10 amino acids.

In certain embodiments of the isolated nucleic acid described above, when the encoded cystine knot polypeptide is processed into a cyclic form, loop 6 comprises an amino acid sequence selected from the group consisting of YRNGVIP (SEQ ID NO:110), YLNGVIP (SEQ ID NO:111), YLDGVP (SEQ ID NO:112), YLNGIP (SEQ ID NO:113), YLDGIP (SEQ ID NO:114), YLNGLP (SEQ ID NO:115), YNNGLP (SEQ ID NO:116), YNDGLP (SEQ ID NO:117), YINGTVP (SEQ ID NO:118), YIDGTVP (SEQ ID NO:119), YNHEP (SEQ ID NO:120), YDHEP (SEQ ID NO:121), LKNGSAF (SEQ ID NO:122), MKNGLP (SEQ ID NO:123), YRNGIP (SEQ ID NO:124), YKNGIP (SEQ ID NO:125), and YRDGVIP (SEQ ID NO:126).

In some embodiments of the isolated nucleic acid molecule the non-cystine knot polypeptide comprises an albumin-1 polypeptide and in certain preferred embodiments, the albumin polypeptide comprises an albumin-1 a-chain.

In some embodiments of the isolated nucleic acid molecule, in the encoded amino acid sequence of the precursor form, the signal peptide is adjacent to the N-terminal amino acid of the mature form of the cystine knot polypeptide.

In some embodiments the present invention provides a composition comprising a host cell comprising a heterologous nucleic acid comprising an isolated nucleic acid as described above. In some embodiments, the host cell is a plant cell, and in certain preferred embodiments, the plant cell is from the plant family Fabaceae. In particularly preferred embodiments, the host cell carries an enzyme for processing a precursor form of the cystine knot polypeptide expressed from the nucleic acid to produce a cyclic cystine knot polypeptide.

In some embodiments, the present invention provides a method for producing a cystine knot polypeptide comprising transforming a host cell with a vector comprising a nucleic acid molecule as described above and the precursor form of the cystine knot polypeptide is expressed in the host cell.

In some embodiments the present invention provides methods for producing a cyclic cystine knot polypeptide, comprising: transforming a host cell with a vector comprising a nucleic acid molecule as described above; expressing a linear precursor form of a cyclic cystine knot polypeptide; and processing the linear precursor form to form a mature cyclic cystine knot polypeptide having the structure:

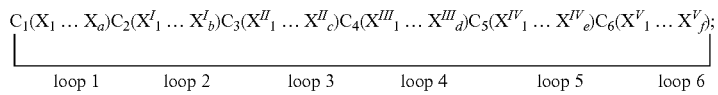

$$C_1(X_1 \ldots X_a)C_2(X^I_1 \ldots X^I_b)C_3(X^{II}_1 \ldots X^{II}_c)C_4(X^{III}_1 \ldots X^{III}_d)C_5(X^{IV}_1 \ldots X^{IV}_e)C_6(X^V_1 \ldots X^V_f);$$

loop 1    loop 2    loop 3    loop 4    loop 5    loop 6

In some embodiments, when the cystine knot polypeptide is processed into a cyclic form, loop 6 comprises an amino acid sequence selected from the group consisting of YRNGVIP (SEQ ID NO:110), YLNGVIP (SEQ ID NO:111), YLDGVP (SEQ ID NO:112), YLNGIP (SEQ ID NO:113), YLDGIP (SEQ ID NO:114), YLNGLP (SEQ ID NO:115), YNNGLP (SEQ ID NO:116), YNDGLP (SEQ ID NO:117), YINGTVP (SEQ ID NO:118), YIDGTVP (SEQ ID NO:119), YNHEP (SEQ ID NO:120), YDHEP (SEQ ID NO:121), LKNGSAF (SEQ ID NO:122), MKNGLP (SEQ ID NO:123), YRNGIP (SEQ ID NO:124), YKNGIP (SEQ ID NO:125), and YRDGVIP (SEQ ID NO:126).

In some embodiments, the host cell is a plant cell, and in certain preferred embodiments, the plant cell is from the plant family Fabaceae. In particularly preferred embodiments, the host cell carries an enzyme for processing the precursor form of the cystine knot polypeptide to produce a cyclic cystine knot polypeptide. In some embodiments, a linear form of the cystine knot polypeptide is cyclized in vitro using, e.g., enzymatic and/or chemical treatment.

BRIEF DESCRIPTION OF THE DRAWINGS

FIG. 9 provides a CLUSTAL 2.1 multiple sequence alignment of nineteen cyclotides from seeds, leaves and flowers of *C. ternatea*. Identical amino acids are indicated by "*", strongly similar amino acids are indicated by ":" and similar amino acids are indicated by ".".

FIG. 10 provides a schematic representation of the complete cDNA sequence (SEQ ID NO:27) and putative translated protein sequence (SEQ ID NO:28) for the Cter M isolate from leaf tissue of butterfly pea (*Clitoria ternatea*). The site of initial degenerate primer Ct-For1A is shown in lower case letters, and gene-specific primers used for 5' RACE are italicized. The mature cyclotide peptide is double underlined and the putative albumin-1 a-chain domain is single-underlined.

FIG. 11A provides a comparison of several genes encoding kalata cyclotides in the Rubiaceae plant *Oldenlandia affinis*.

FIG. 11B provides a comparison of the gene structures for two Fabaceae family albumin genes [*Glycine max* (soybean) albumin-1 and *Pisum savitum* (green pea) albumin-1] with the gene encoding the Cter M cyclotide isolate from *C. ternatea*.

FIG. 13 provides an alignment of several complete and partial precursor cyclotide polypeptides from *C. ternatea*.

FIG. 17 illustrates the effect of Cter M and kB1 on the growth of *Helicoverpa armigera*. The weight of larvae at 0, 24 and 48 h is plotted versus peptide concentration for Cter M (A) and kB1 (B) and the size of control larvae (bottom, right) alongside larvae fed at medium (0.25 μmol/g diet) (top, right) and high (1.0 μmol/g diet)(top, left) peptide concentrations at 48 h is depicted for Cter M (C) and kB1 (D).

FIG. 21 provides a sensorgram for Cter M binding to POPC vesicles (A) immobilized on the chip surface. The peptide samples were injected from 0 to 180 s otherwise buffer was flowing. The sensorgrams were referenced using a blank flow cell with no peptide. Equilibrium binding curves for Cter M and kB1 binding to immobilized lipid vesicles (B). Fit to the single site binding model is shown as a solid line.

DEFINITIONS

Figure 1:
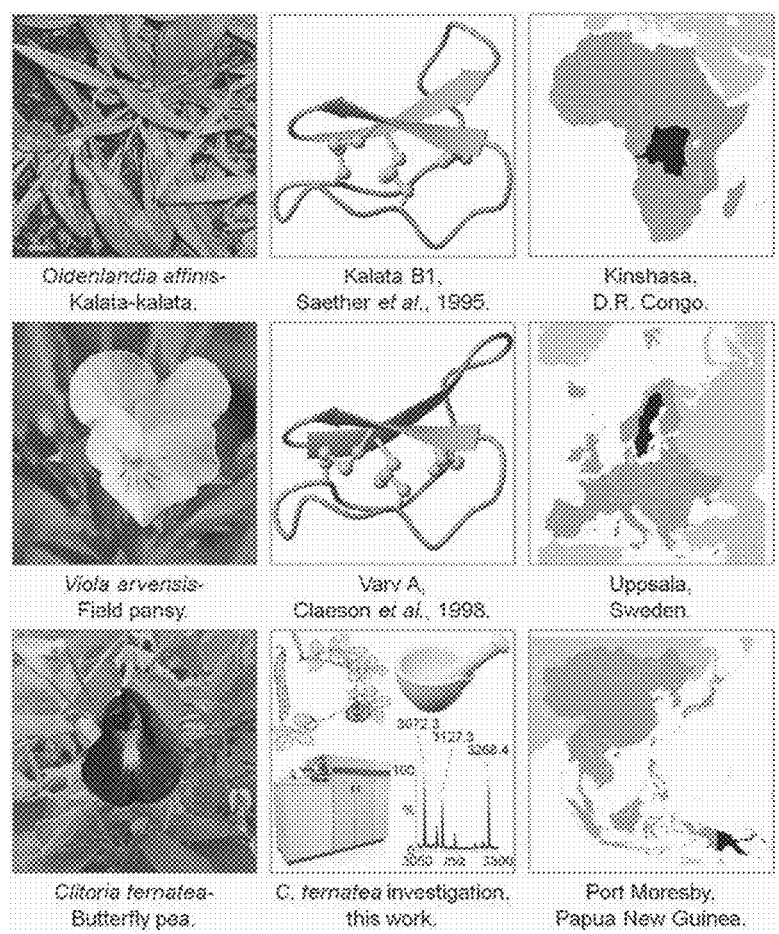
FIG. 1 provides a diagram illustrating the botanical and geographical origins of the first cyclotides described from Rubiaceae, Violaceae and Fabaceae plant families.

As used herein, the term "molecular framework" refers to a proteinaceous molecule having a defined three-dimensional structure. This defined three-dimensional structure comprises loops of amino acid residues and other elements of molecular structure held in defined orientation with respect to each other. The molecular framework itself may exhibit a particularly useful property such as having anti-pathogen activities against viruses, microorganisms, fungi, yeast, arachnids and insects or it may confer useful therapeutic properties in plants or animals. Furthermore, it may provide the framework for inserting one or more amino acids or amino acid sequences capable of conferring a desired biological effect. Insertion of one or more amino acid residues or sequences may occur on a beta-turn or within a loop. The molecular framework may also be presented in a linear form as a substrate for cyclization. Alternatively, a cyclic molecule may be derivatized into a linear form which itself may have useful properties or it may act as an agonist or antagonist of such properties.

The sequence of amino acids forming the backbone of the molecular framework may be naturally occurring amino acid residues or chemical analogues thereof. Chemical analogues of amino acid residues include non-naturally occurring amino acids. Examples of non-naturally occurring amino acids are shown in Table 3.

By way of example, when a molecular framework in the form of a cyclic polypeptide is isolated and purified from a biological source, such as a plant, the molecule generally comprises naturally occurring amino acid residues. However, the present invention extends to derivatives of such a molecular framework resulting from the insertion or substitution of non-naturally occurring amino acid residues or chemical analogues of amino acid residues. Alternatively, a single and/or a heterologous sequence of naturally occurring amino acid residues may be inserted or substituted into the molecular framework to confer desired properties on the molecule.

As used herein, the term "cyclic backbone" refers to a molecule comprising a sequence of amino acid residues or analogues thereof without free amino and carboxy termini. Preferably, the linkage between all amino acids in the cyclic backbone is via amide (peptide) bonds, but other chemical linkers are also possible. The cyclic backbone of the molecular framework of the present invention comprises sufficient disulfide bonds, or chemical equivalents thereof, to confer a knotted topology on the three-dimensional structure of the cyclic backbone.

In some embodiments, a cyclic backbone comprises a structure referred to herein as a "cystine knot". A cystine knot occurs when a disulfide bond passes through a closed cyclic loop formed by two other disulfide bonds and the amino acids in the backbone. Such a cystine knot is referred to herein as a "cyclic cystine knot" or "CCK". However, reference herein to a "cyclic cystine knot" or a "CCK" includes reference to structural equivalents thereof which provide similar constraints to the three-dimensional structure of the cyclic backbone. For example, appropriate turns and loops in the cyclic backbone may also be achieved by engineering suitable covalent bonds or other forms of molecular associations. All such modifications to the cyclic backbone which result in retention of the three-dimensional knotted topology conferred by the cyclic cystine knot are encompassed by the present invention. Furthermore, although a cyclic cystine knot is characterized by a knot formed by three disulfide bonds, the present invention extends to molecules comprising only two disulfide bonds. In such a case, the molecular framework may need to be further stabilized using other means or the molecular framework may retain suitable activity despite a change in three-dimensional structure caused by the absence of a third disulfide bond.

Cyclic backbones may comprise more than three disulfide bonds such as those occurring in a double or multiple cystine knot arrangement or in a single cystine knot arrangement supplemented by one or two additional disulfide bonds.

The term "cyclic cystine knot" and "CCK" and "cyclotide" are used interchangeably and encompass natural cystine knot peptides, as well as cystine knot peptides comprising modified amino acids, substituted loop sequences, grafted peptides, and other modifications. The terms "knot" and "cystine knot" are not to be limited by any mathematical or geometrical definition of the term "knot". The knots contemplated by the present invention are referred to as such due to their similarity to a mathematical knot and/or by virtue of the intertwined features of the folded molecule.

The present invention provides, therefore, genes and expression systems encoding a molecular framework comprising a sequence of amino acids or analogues thereof forming a cyclic backbone and wherein said cyclic backbone comprises a cystine knot or its chemical or structural equivalent which confers a knotted topology on the three-dimensional structure of said cyclic backbone.

Accordingly, one aspect of the present invention contemplates an isolated nucleic acid molecule encoding a molecular framework comprising a sequence of amino acids forming a cyclic backbone wherein the cyclic backbone comprises sufficient disulfide bonds or chemical equivalents hereof to confer knotted topology on the molecular framework or part thereof wherein said cyclic backbone comprises the structure:—

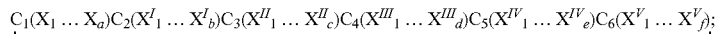

wherein C is cysteine; each of $(X_1 \ldots X_a)$, $(X^I_1 \ldots X^I_b)$, $(X^{II}_1 \ldots X^{II}_c)$, $(X^{III}_1 \ldots X^{III}_d)$, $(X^{IV}_1 \ldots X^{IV}_e)$, $(X^V_1 \ldots X^V_f)$ represents one or more amino acid residues, wherein each one or more amino acid residues within or between the cysteine residues may be the same or different; and wherein a, b, c, d, e and f represent the number of amino acid residues in each respective sequence. In some embodiments, a, b, c, d, e and f may range from 1 to about 10, 11, 12, 13, 14, 15, 16, 17, 18, 19, or 20.

In certain preferred embodiments, the cyclic backbone of the present invention comprises the structure:

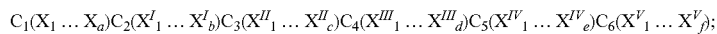

wherein a is about 6, b is about 5, c is about 3, d is about 1 or 2, e is about 5 and f is about 8; or an analogue of said sequence.

The molecular framework of the present invention is also referred to herein as a "cyclotide". A cyclotide is regarded as being equivalent to a molecular framework as herein described and, in its most preferred embodiment, comprises a cyclic cystine knot motif defined by a cyclic backbone, at least two but preferably at least three disulfide bonds and associated beta strands in a particular knotted topology. The knotted topology involves an embedded ring formed by at least two disulfide bonds and their connecting backbone segments being threaded by a third disulfide bond. As stated above, however, a disulfide bond may be replaced or substituted by another form of bonding such as a covalent bond.

Each amino acid has a carboxyl group and an amine group, and amino acids link to one another to form a chain by joining the amine group of one amino acid to the carboxyl group of the next. Thus, linear polypeptide chains generally have an end with an unbound carboxyl group, the C-terminus, and an end with an amine group, the N-terminus. The convention for writing polypeptide sequences is to put the N-terminus on the left and write the sequence from N- to C-terminus. Sequences with longer or non-linear (e.g., cyclized) polypeptide that do not have unbound termini can nonetheless be directionally oriented by reference to the direction of the N and C groups on internal amino acid residues. For example, the amino acid in an internal region that would have a carboxyl group if on a terminus may be referred to as the C-terminal end of the internal sequence. The N and C designations also are used to indicate directionality on a polypeptide strand. For example, a first region of a polypeptide sequence that is attached by its C-terminal residue to the N-terminal residue of a second region of the same polypeptide may be referred to as being in the N or N-terminal direction from the second region. Conversely, the second region is in the C or C-terminal direction from the first region.

As used herein, the term "adjacent" as used in reference to amino acids or peptide regions refers to residues or regions that are contiguous or are immediately next to each other, e.g., in a polypeptide chain, with no intervening residues.

The terms "peptide" and "polypeptide" are used interchangeably herein to refer to a chain comprising a plurality amino acid residues connected by peptide bond(s). "Residue" as used in reference to an amino acid refers to an individual amino acid in a polypeptide chain.

As used herein, the term "graft" or "grafted" as used in reference to a peptide sequence used to modify a framework molecule, refers to the integration of a heterologous sequence of amino acids (a "heterologous peptide") into the polypeptide strand at one or more positions on a framework molecule. For example, one or more loops of a CCK molecule may be made to comprise a heterologous sequence of amino acids in addition to, or as a full or partial replacement for a normal or native loop sequence. Grafting of a peptide into a CCK framework molecule need not be done after the proteinaceous framework molecule has been produced. In certain preferred embodiments, a peptide sequence, e.g., a bioactive peptide, is grafted into a framework proteinaceous molecule by creation of a nucleic acid molecule comprising a nucleotide sequence that encodes the framework CCK molecule along with the grafted peptide amino acid sequence.

In addition to the grafts described above, the present invention encompasses a range of amino acid substitutions, additions and/or insertions to the amino acid sequence of the molecular framework. Substitutions encompass amino acid alterations in which an amino acid is replaced with a different naturally-occurring or a non-conventional amino acid residue. Such substitutions may be classified as "conservative", in which case an amino acid residue contained in a polypeptide is replaced with another naturally-occurring amino acid of similar character either in relation to polarity, side chain functionality, or size, for example, Ser↔Thr↔Pro↔Hyp↔Gly↔Ala, Val↔Ile↔Leu, His↔Lys↔Arg, Asn↔Gln↔Asp↔Glu or Phe↔Trp↔Tyr. It is to be understood that some nonconventional amino acids may also be suitable replacements for the naturally occurring amino acids. For example, ornithine, homoarginine and dimethyllysine are related to His, Arg and Lys.

Substitutions encompassed by the present invention may also be "non-conservative", in which an amino acid residue which is present in a polypeptide is substituted with an amino acid having different properties, such as a naturally-occurring amino acid from a different group (e.g. substituting a charged or hydrophobic amino acid with alanine), or alternatively, in which a naturally-occurring amino acid is substituted with a nonconventional amino acid.

Amino acid substitutions are typically of single residues, but may be of multiple residues, either clustered or dispersed. Amino acids of the cyclic peptide backbone are preferably conservative in order to maintain the three-dimensional structure in a form functionally similar to the cyclic peptide before derivatization. Substitutions of amino acid residues in the cyclic peptide to introduce or otherwise graft heterologous sequences onto the backbone need not be conservative.

Additions encompass the addition of one or more naturally occurring or non-conventional amino acid residues. Deletion encompasses the deletion of one or more amino acid residues.

The present invention also includes molecules in which one or more of the amino acids has undergone side chain modifications. Examples of side chain modifications contemplated by the present invention include modifications of amino groups such as by reductive alkylation by reaction with an aldehyde followed by reduction with NaBH$_4$; amidination with methylacetimidate; acylation with acetic anhydride; carbamoylation of amino groups with cyanate; trinitrobenzylation of amino groups with 2,4,6-trinitrobenzene sulphonic acid (TNBS); acylation of amino groups with succinic anhydride and tetrahydrophthalic anhydride; and pyridoxylation of lysine with pyridoxal-5-phosphate followed by reduction with NaBH$_4$.

The guanidine group of arginine residues may be modified by the formation of heterocyclic condensation products with reagents such as 2,3-butanedione, phenylglyoxal and glyoxal.

The carboxyl group may be modified by carbodiimide activation via O-acylisourea formation followed by subsequent derivitization, for example, to a corresponding amide.

Sulfhydryl groups may be modified by methods such as carboxymethylation with iodoacetic acid or iodoacetamide; performic acid oxidation to cysteic acid; formation of mixed disulfides with other thiol compounds; reaction with maleimide, maleic anhydride or other substituted maleimide; formation of mercurial derivatives using 4-chloromercuribenzoate, 4-chloromercuriphenylsulphonic acid, phenylmercury chloride, 2-chloromercuri-4-nitrophenol and other mercurials; carbamoylation with cyanate at alkaline pH. Any modification of cysteine residues preferably does not affect the ability of the peptide to form the necessary disulfide bonds. It is also possible to replace the sulfhydryl groups of cysteine with selenium or tellurium equivalents such that the peptide forms a diselenide or ditelluride bond in place of one or more of the disulfide bonds.

Tryptophan residues may be modified by, for example, oxidation with N-bromosuccinimide or alkylation of the indole ring with 2-hydroxy-5-nitrobenzyl bromide or sulphenyl halides. Tyrosine residues on the other hand, may be altered by nitration with tetranitromethane to form a 3-nitrotyrosine derivative. Modification of the imidazole ring of a histidine residue may be accomplished by alkylation with iodoacetic acid derivatives or N-carbethoxylation with diethylpyrocarbonate. Proline residues may be modified by, for example, hydroxylation in the 4-position. Other modifications include succinimide derivatives of aspartic acid.

A list of some amino acids having modified side chains and other unnatural amino acids is shown in Table 3, below.

TABLE 3

| Non-conventional amino acid | Code | Non-conventional amino acid | Code |
| --- | --- | --- | --- |
| α-aminobutyric acid | Abu | L-N-methylalanine | Nmala |
| α-amino-α-methylbutyrate | Mgabu | L-N-methylarginine | Nmarg |
| aminocyclopropane-carboxylate | Cpro | L-N-methylasparagine | Nmasn |
|  |  | L-N-methylaspartic acid | Nmasp |
| aminoisobutyric acid | Aib | L-N-methylcysteine | Nmcys |
| aminonorbornyl-carboxylate | Norb | L-N-methylglutamine | Nmgln |
|  |  | L-N-methylglutamic acid | Nmglu |
| α-aspartic acid | Aaa |  |  |
| β-aspartic acid | Baa |  |  |
| cyclohexylalanine | Chexa | L-Nmethylhistidine | Nmhis |
| cyclopentylalanine | Cpen | L-N-methylisolleucine | Nmile |
| D-alanine | Dal | L-N-methylleucine | Nmleu |
| D-arginine | Darg | L-N-methyllysine | Nmlys |
| D-aspartic acid | Dasp | L-N-methylmethionine | Nmmet |
| D-cysteine | Dcys | L-N-methylnorleucine | Nmnle |
| D-glutamine | Dgln | L-N-methylnorvaline | Nmnva |
| D-glutamic acid | Dglu | L-N-methylornithine | Nmorn |
| D-histidine | Dhis | L-N-methylphenylalanine | Nmphe |
| D-isoleucine | Dile | L-N-methylproline | Nmpro |
| D-leucine | Dleu | L-N-methylserine | Nmser |
| D-lysine | Dlys | L-N-methylthreonine | Nmthr |
| D-methionine | Dmet | L-N-methyltryptophan | Nmtrp |
| D-ornithine | Dorn | L-N-methyltyrosine | Nmtyr |
| D-phenylalanine | Dphe | L-N-methylvaline | Nmval |
| D-proline | Dpro | L-N-methylethylglycine | Nmetg |
| D-serine | Dser | L-N-methyl-t-butylglycine | Nmtbug |
| D-threonine | Dthr | L-norleucine | Nle |
| D-tryptophan | Dtrp | L-norvaline | Nva |
| D-tyrosine | Dtyr | α-methyl-aminoisobutyrate | Maib |
| D-valine | Dval | α-methyl-γ-aminobutyrate | Mgabu |
| D-α-methylalanine | Dmala | α-methylcyclohexylalanine | Mchexa |

TABLE 3-continued

| Non-conventional amino acid | Code | Non-conventional amino acid | Code |
|---|---|---|---|
| D-α-methylarginine | Dmarg | α-methylcyclopentylalanine | Mcpen |
| D-α-methylasparagine | Dmasn | α-methyl-α-napthylalanine | Manap |
| D-α-methylaspartate | Dmasp | α-methylpenicillamine | Mpen |
| D-α-methylcysteine | Dmcys | N-(4-aminobutyl)glycine | Nglu |
| D-α-methylglutamine | Dmgln | N-(2-aminoethyl)glycine | Naeg |
| D-α-methylhistidine | Dmhis | N-(3-aminopropyl)glycine | Norn |
| D-α-methylisoleucine | Dmile | N-amino-α-methylbutyrate | Nmaabu |
| D-α-methylleucine | Dmleu | α-napthylalanine | Anap |
| D-α-methyllysine | Dmlys | N-benzylglycine | Nphe |
| D-α-methylmethionine | Dmmet | N-(2-carbamylethyl)glycine | Ngln |
| D-α-methylornithine | Dmorn | N-(carbamylmethyl)glycine | Nasn |
| D-α-methylphenylalanine | Dmphe | N-(2-carboxyethyl)glycine | Nglu |
| D-α-methylproline | Dmpro | N-(carboxymethyl)glycine | Nasp |
| D-α-methylserine | Dmser | N-cyclobutylglycine | Ncbut |
| D-α-methylthreonine | Dmthr | N-cycloheptylglycine | Nchep |
| D-α-methyltryptophan | Dmtrp | N-cyclohexylglycine | Nchex |
| D-α-methyltyrosine | Dmty | N-cyclodecylglycine | Ncdec |
| D-α-methylvaline | Dmval | N-cyclododeclglycine | Ncdod |
| D-N-methylalanine | Dnmala | N-cyclooctylglycine | Ncoct |
| D-N-methylarginine | Dnmarg | N-cyclopropylglycine | Ncpro |
| D-N-methylasparagine | Dnmasn | N-cycloundecylglycine | Ncund |
| D-N-methylasparatate | Dnmasp | N-(2,2-diphenylethyl)glycine | Nbhm |
| D-N-methylcysteine | Dnmcys | N-(3,3-diphenylpropyl)glycine | Nbhe |
| D-N-methylglutamine | Dnmgln | N-(3-guanidinopropyl)glycine | Narg |
| D-N-methylglutamate | Dnmglu | N-(1-hydroxyethy)glycine | Nthr |
| D-N-methylhistidine | Dnmhis | N-(hydroxyethy))glycine | Nser |
| D-N-methylisoleucine | Dnmile | N-(imidazolylethyl))glycine | Nhis |
| D-N-methylleucine | Dnmleu | N-(3-indolylyethyl)glycine | Nhtrp |
| D-N-methyllysine | Dnmlys | N-methyl-γ-aminobutyrate | Nmgabu |
| N-methylcyclohexylalanine | Nmchexa | D-N-methylmethionine | Dnmmet |
| D-N-methylornithine | Dnmorn | N-methylcyclopentylalanine | Nmcpen |
| N-methylglycine | Nala | D-N-methylphenylalanine | Dnmphe |
| N-methylaminoisobutyrate | Nmaib | D-N-methylproline | Dnmpro |
| N-(1-methylpropyl)glycine | Nile | D-N-methylserine | Dnmser |
| N-(2-methylpropyl)glycine | Nleu | D-N-methylthreonine | Dnmthr |
| D-N-methyltryptophan | Dnmtrp | N-(1-methylethyl)glycine | Nval |
| D-N-methyltyrosine | Dnmtyr | N-methyla-napthylalanine | Nmanap |
| D-N-methylvaline | Dnmval | N-methylpenicillamine | Nmpen |
| γ-aminobutyric acid | Gabu | N-(p-hydroxyphenyl)glycine | Nhtyr |
| L-t-butylglycine | Tbug | N-(thiomethyl)glycine | Ncys |
| L-ethylglycine | Etg | penicillamine | Pen |
| L-homophenylalanine | Hphe | L-α-methylalanine | Mala |
| L-α-methylarginine | Marg | L-α-methylasparagine | Masn |
| L-α-methylaspartate | Masp | L-α-methyl-t-butylglycine | Mtbug |
| L-α-methylcysteine | Mcys | L-methylethylglycine | Metg |
| L-α-methylglutamine | Mgln | L-α-methylglutamate | Mglu |
| L-α-methylhistidine | Mhis | L-α-methylhomophenylalanine | Mhphe |
| L-α-methylisoleucine | Mile | N-(2-methylthioethyl)glycine | Nmet |
| L-α-methylleucine | Mleu | L-α-methyllysine | Mlys |
| L-α-methylmethionine | Mmet | L-α-methylnorleucine | Mnle |
| L-α-methylnorvaline | Mnva | L-α-methylornithine | Morn |
| L-α-methylphenylalanine | Mphe | L-α-methylproline | Mpro |
| L-α-methylserine | Mser | L-α-methylthreonine | Mthr |
| L-α-methyltryptophan | Mtrp | L-α-methyltyrosine | Mtyr |
| L-α-methylvaline | Mval | L-N-methylhomophenylalanine | Nmhphe |
| N-(N-(2,2-diphenylethyl) carbamylmethyl)glycine | Nnbhm | N-(N-(3,3-diphenylpropyl) carbamylmethyl)glycine | Nnbhe |
| 1-carboxy-1-(2,2-diphenyl-ethylamino)cyclopropane | Nmbc | | |

As used herein, the terms "isolated" or "substantially isolated" as used in reference to molecules, e.g., either nucleic or amino acid, refers to molecules that are removed from their natural environment, purified or separated, and are at least partially free, preferably 50% free, more preferably 75% free, and most preferably 90% free from other components with which they are naturally associated. An "isolated" molecule that is separated from components with which it is associated in nature need not be isolated from other materials, and may be, for example, combined with other components e.g., heterologous host cell components, reaction components and the like.

DETAILED DESCRIPTION OF THE INVENTION

The present invention provides cyclotides isolated from plants in the Fabaceae family of plants. In some embodiments, the present invention further provides isolated nucleic acids configured for expression in plants of the Fabaceae family and encoding a molecular framework comprising a sequence of amino acids or analogues thereof forming a cyclic backbone, wherein said cyclic backbone comprises sufficient disulfide bonds, or chemical equivalents thereof, to confer a knotted topology on the three-dimensional structure of said cyclic backbone. In still other embodiments, the present invention provides isolated nucleic acids configured for expression in plants of the Fabaceae family and encoding a molecular framework as described above and containing a heterologous grafted peptide. In preferred embodiments, the grafted peptide confers a bioactivity on said molecular framework molecule.

The Fabaceae (legume) plant family is the third largest family of plants on earth comprising 18,000 species, many of which, e.g., peas and beans, are centrally involved in human nutrition. The discovery of cyclotides in the Fabaceae family broadens interest in this family of molecules because it facilitates the possibility of expressing genetically modified cyclotide sequences in crop plants from the Fabaceae. In addition to their importance as crop plants, multiple members of the Fabaceae family of plants are amenable to transfection. Modification of these plants to express foreign or engineered cyclotides finds a number of applications, including conferring insect resistance traits on the host plants themselves. In some embodiments, the host plants may be used to manufacture cyclotides having, for example, pharmaceutical attributes. It is envisioned that expressed cyclotides may be purified from the host plants or, in some embodiments, plant materials having beneficial pharmaceutical attributes may be used directly, e.g., in foods or food supplements or in the preparation of topical treatments, etc.

The present invention provides a genetic system for the expression of cyclotides in the Fabaceae plant family. We provide herein nucleic acid sequences encoding cyclotides from the Fabaceae plant family and show that the corresponding peptide is ultra-stable and insecticidal like other cyclotides, but has an unexpected biosynthetic origin in that it is embedded within an albumin precursor sequence.

In some embodiments, the present invention comprises isolated nucleic acids configured to encode Fabaceae-derived cyclotides comprising grafted heterologous peptides. The heterologous amino acids inserted or substituted in the molecular framework have the capacity to confer a range of activities and biological properties to the molecule including modulating calcium channel-binding, which is useful in the treatment of pain or a stroke, C5a binding, useful as an anti-inflammatory agent, proteinase inhibitor activity in plants or animals, antibiotic activity, anti-HIV activity, antimicrobial activity, anti-fungal activity, anti-viral activity, anthelmintic activity, cytokine binding ability and blood clot inhibition and plant pathogen activity (e.g., insecticidal activity) amongst other properties. The molecule may be a modulator in the sense that it may facilitate the activity or inhibit the activity. Accordingly, the molecule may act as an agonist or antagonist. Furthermore, the heterologous amino acids may form a sequence which may be readily cleaved to form a linear molecule, or to activate a peptide that requires cleavage by a proteinase for activation.

Peptides having defined biological activity, including peptides containing about 30 or fewer amino acid residues, particularly suitable for grafting, are well known. At this time, tens of thousands of peptides of this kind have been described in the scientific literature and have been recorded in peptide databases. See, e.g., Peptide Atlas published on the worldwide web at peptideatlas.org, at or PepBank, maintained online by Massachusetts General Hospital, Harvard University, Cambridge, Mass., each incorporated by reference herein. In addition, screening of peptides of unknown sequence to identify peptides having defined biological activities, including random combinatorial libraries containing millions of peptides, is conventional in the art and requires no knowledge of what amino acid sequence or peptide structure would predictably result in the desired activity. See, for example, Cortese, et al., (1995) Curr. Opin. Biotech. 6:73-80, incorporated by reference herein, which discusses of the phage display method of screening random combinatorial peptide libraries. In some embodiments, the present invention comprises selecting an amino acid sequence of a peptide having a defined biological activity, preparing protein molecules having cyclic cystine knot backbones in which one or more of the loops contains the amino acid sequence of the peptide, and screening the prepared proteins using an assay for the defined biological activity so as to identify a CCK protein having the defined biological activity. In some embodiments, the peptide has a sequence of about 30 or fewer amino acids. In certain embodiments, peptides are grafted into one or more of loops 1, 2, 3, 4, 5, and/or 6. In certain preferred embodiments, peptides are grafted into one or more of loops 1, 2, 3, 5, and/or 6.

While some embodiments of CCK molecules contain loops comprising 1 to about 7 amino acids, it is known that cystine knot structures comprising six cysteines and three disulfide bonds can be formed with larger polypeptides. Larger polypeptides of this configuration have loop sizes from 1 up to 30 or more amino acid residues.

The molecular frameworks of the Fabaceae CCK molecules permit modifications to be made to the molecule while retaining the stable structural scaffold. Such modifications include, for example, different amino acid residues inserted or substituted anywhere in the molecule but preferably in one or more beta-turns and/or within a loop. The newly exposed amino acids, for example, may provide functional epitopes or activities not present in the molecular framework prior to modification. Alternatively, the newly exposed amino acids may enhance an activity already possessed by the molecular framework. A substitution or insertion may occur at a single location or at multiple locations. Furthermore, the molecular framework may be specifically selected to more readily facilitate substitution and/or insertion of amino acid sequences. Such modified forms of the molecular framework are proposed to have a range of useful properties including as therapeutic agents for animals and mammals (including humans) and plants. Therapeutic agents for plants include pest control agents. As stated above, the molecular framework has advantages in terms of increased stability relative to, for example, conventional peptide drugs. The increased stability includes resistance or less susceptibility to protease cleavage. Furthermore, the molecules may have a hydrophobic face which may benefit their interaction with membranes while still being highly water soluble.

Accordingly, another aspect of the present invention is directed to a Fabaceae molecular framework comprising a sequence of amino acids or analogues thereof forming a cyclic backbone and wherein said cyclic backbone comprises sufficient disulfide bonds or chemical equivalents thereof, to confer a knotted topology on the three-dimensional structure of said cyclic backbone and wherein at least one exposed amino acid residue such as on one or more beta turns and/or within one or more loops, is inserted or substituted relative to the naturally occurring amino acid sequence.

Even more particularly, the present invention contemplates a Fabaceae molecular framework comprising a sequence of amino acids or analogues thereof forming a cyclic backbone and wherein said cyclic backbone comprises a cystine knot or its chemical or structural equivalent which confers a knotted topology on the three-dimensional structure of said cyclic backbone and wherein at least one exposed amino acid residue such as on one or more beta turns and/or within one or more loops is inserted or substituted relative to the naturally occurring amino acid sequence.

More particularly, the present invention is directed to a Fabaceae molecular framework comprising a sequence of amino acids or analogues thereof forming a cyclic cystine knot motif defined by a cyclic backbone, at least three disulfide bonds and associated beta stands in a defined knotted topology and wherein at least one exposed amino acid residue such as on one or more beta turns or within one or more loops is inserted or substituted relative to the naturally occurring amino acid sequence.

It is contemplated that in some embodiments, a cyclic cystine knot is formed by expression of a linear precursor molecule comprising the cystine knot motif in a host cell that comprises a system of one or more enzymes for processing a precursor form of a cystine knot polypeptide to produce a cyclic cystine knot polypeptide. In other embodiments, a cystine knot polypeptide is cyclized in vitro. In some embodiments, in vitro processing is carried out enzymatically, e.g., using an isolated enzymatic processing system e.g., from a cyclotide-forming plant species, while in some embodiments, in vitro cyclizing is done by chemical treatment, e.g. in ammonium bicarbonate with triscarboxyethyl-phosphine (TCEP), as described, e.g., by Craik, et al., US Patent Publication 2003/0158096, which is incorporated by reference herein it its entirety for all purposes.

Although the inserted or substituted amino acid is preferably an exposed amino acid on a beta turn, the present invention contemplates an inserted or substituted amino acid anywhere on the molecule.

The inserted or substituted amino acid residues may be a single residue or may be a linear sequence of from about two residues to about 60 residues, preferably from about two to about 30 residues, and even more preferably, from about 2 residues to about 10 residues. The insertion or substitution may occur at a single location or at multiple locations. The latter includes the insertion of non-contiguous amino acid sequences. Furthermore, different amino acid molecules may be inserted/substituted at different sites on the molecule. This is particularly useful in the preparation of multivalent or multifunctional molecules.

Figure 2:
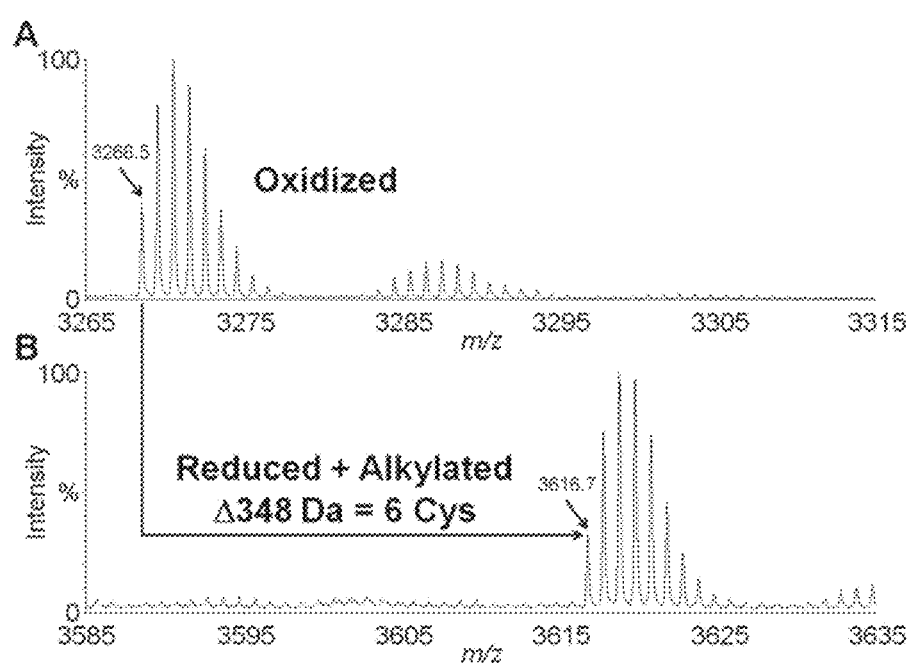
FIG. 2 provides MALDI-TOF spectra indicating the presence of cyclotides in C. ternatea seed extract. Offset-aligned MALDI-TOF spectra of 'native' (A) and 'reduced and carbamidomethylated' (B) putative cyclotide species, Cter A.

One example of a class of larger cystine knotted polypeptides is the Vascular Endothelial Growth Factors (VEGFs), described in the reference by K. Suto, et al., (2005) J. Biol. Chem. 290:2126. For example, VEGF-A$_{165}$ is composed of 165 residues (p 2126, col 2). Suto et al., provides a sequence comparison of two VEGF-related proteins called vammin (110 residues) and VR-1 (109 residues) to VEGF-A$_{165}$ and PlGF (Placental Growth Factor). As shown in FIG. 2 of Suto et al., each of these cystine knot polypeptides contains loops of up to 33 amino acid residues.

Inclusion of loops of 30 or more amino acids is not limited to the VEGF polypeptides. See, e.g., Table 2, which comprises about 1500 naturally occurring polypeptides containing cystine knot motifs. Each of the polypeptides listed has been reported to contain a cystine knot comprising six cysteine residues and at least five loops, while circular molecules have a sixth loop. The polypeptides are identified by database identifiers listed in column 1. The table provides the complete list of polypeptides reciting the sizes of each of loops in its cystine knot motif, and shows the amino acid sequences of each of the loops in its cystine knot motif. The table of cystine knot polypeptide sequences provided herewith shows that cystine knot structures can readily accommodate 30 or more amino acids in one or several loops.

Identification of Cyclotides in C. ternatea.

Clitoria ternatea, an ornamental perennial climber also known as the Butterfly pea, is a member of plant family Fabaceae, originally from Africa but now also distributed among equatorial Asiatic countries and the Americas. Preparations of C. ternatea are utilized in a variety of indigenous medicines throughout these regions, with anecdotal evidence of their use in the traditional medicines of the Philippines, Cuba and Indo-China to promote uterine contractions and expedite childbirth (Fantz, P. R. (1991) Econ. Bot. 45, 511-520; Mukherjee, P. K., et al. (2008) J. Ethnopharmacol. 120, 291-301).

Initial screening of crude seed extracts of C. ternatea revealed the presence of proteins with masses in the range 2500-4000 Da, consistent with those of known cyclotides. Following preparative RP-HPLC of the crude extract, the putative cyclotides were detected in late-eluting fractions via MALDI-TOF MS (FIG. 2A), and the masses of 12 of these putative cyclotides are reported in Table 1. In accordance with established diagnostic methodology for cyclotides (Gruber, supra), purified peptides were lyophilized, reduced and carbamidomethylated, and re-analyzed via MALDI-TOF MS. Mass increases of 348 Da, were observed following this process (FIG. 2B), indicating the presence of three intramolecular disulfide bonds in the corresponding proteins. Thus, the 12 peptides complied with all three diagnostic criteria previously identified for cyclotides (Gruber, supra), of mass profile, hydrophobicity profile, and disulfide content.

Seven cyclotide sequences were also identified from C. ternatea leaf and flower of which one, Cter A, was common to seed. Cter M was tested for insecticidal activity and was determined to have insecticidal activity against the cotton budworm Helicoverpa armigera and anthelmintic activity against Haemonchus contortus. Cter M also binds to PE membranes, suggesting its activity is modulated by membrane disruption. Sequences of the leaf and flower cyclotides, along with the seed cyclotides, are shown in FIG. 9.

Tandem MS Enables the Differentiation of Cyclotides from Linear Peptides.

Figure 3:
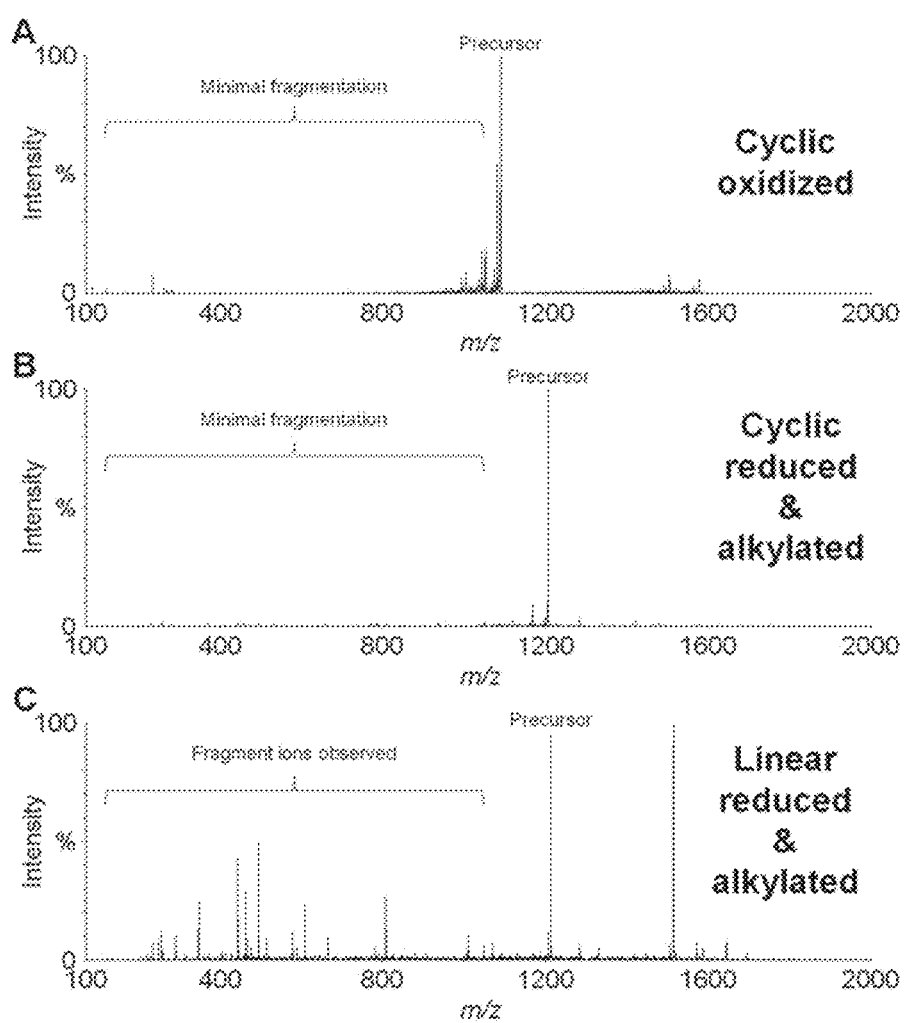
FIG. 3 provides nanospray tandem MS fragmentation patterns for 'native' vs. chemically modified Cter A at a collision energy setting of 50 V. (A) 'Native' (cyclic oxidized) cyclotide precursor m/z 1090.1, (B) cyclic reduced and alkylated precursor m/z 1206.1, (C) linear reduced and alkylated precursor m/z 1212.1. These apparent triply-charged fragment ions correspond to species of molecular masses 3267 Da, 3615 Da and 3633 Da, respectively.

There are several examples of linear proteins, including knottins and also some defensins, which are of similar size to cyclotides, possess three disulfide bonds, and display hydrophobic properties. Therefore, we sought to extend the diagnostic criteria for the detection of cyclotides by including an additional step to distinguish between peptides with cyclic or linear backbones. This additional step is illustrated for the putative cyclotide from C. ternatea seed extract, Cter A, with a 'native' mass of 3267.3 Da that increases by 348 Da after reduction and carbamidomethylation and a further 18 Da after enzymatic digestion of the peptide backbone with endoproteinase Glu-C (FIG. 3). The determination of peptide sequence via tandem MS relies in part upon the ability of the N- and C-termini to retain charge. The absence of termini in cyclotides, brought about by their macrocyclic peptide backbone, therefore prevents their efficient fragmentation in tandem MS analyses, either as fully folded CCK-containing 'native' proteins or as reduced and alkylated cyclic proteins, as illustrated for Cter A in panels A and B of FIG. 3, respectively. Only after enzymatic cleavage of reduced (or reduced and alkylated) C. ternatea peptides into their linear forms were the various fragment ions detected during tandem MS analyses (FIG. 3C). Hence, we propose that the characteristic lack of fragmentation observed in tandem MS analyses of reduced and/or reduced and alkylated cyclotides is a suitable determinant of their cyclic nature, and should be added to previously proposed criteria (Gruber, supra) as an indicator for the presence of cyclotides in a given plant.

In combination, the newly defined criteria proposed here for the positive identification of cyclotides are late-eluting properties via RP-HPLC, a mass of 2500 to 4000 Da, an increase in mass of 348 Da following reduction and alkylation with iodoacetamide, and inefficient fragmentation in MS/MS analyses of 'native' or reduced and alkylated forms. Although yet to be described from plants, cyclic peptides with three intramolecular disulfide bonds not forming a cystine knot arrangement, similar to rhesus θ-defensin-1 (Tang, Y.-Q., et al., (1999) Science 286, 498-502), could also meet these criteria. However, judging from the size and hydrophobicity of described O-defensins, false positives are unlikely.

De Novo Sequencing of Cyclotides.

Figure 4:
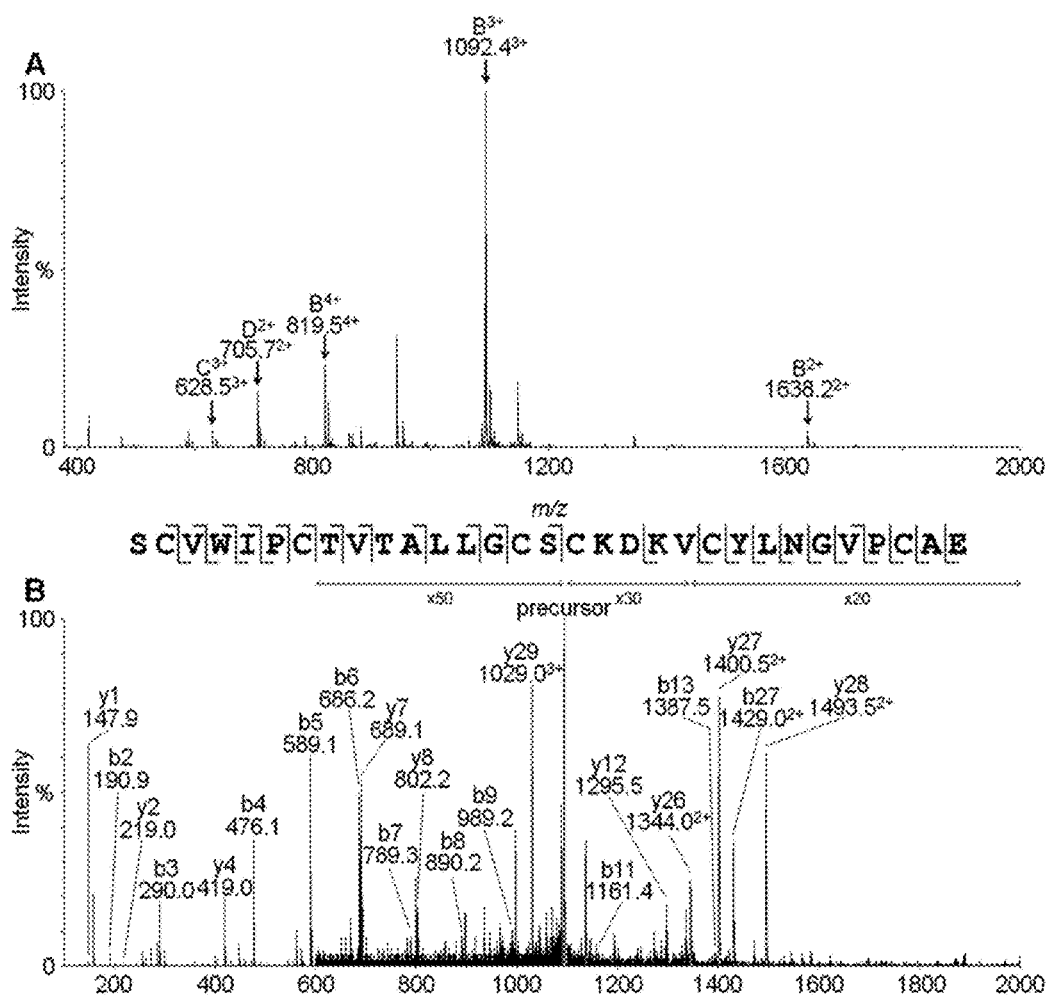
FIGS. 4A-E provide nanospray sequencing of Cter B. (A) TOF-MS spectrum of combined trypsin and endoproteinase Glu-C digest. The peaks are labelled according to their charge state, where $B^{2+}$, $B^{3+}$ and $B^{4+}$ correspond to the full-length linearized Cter B, and $C^{3+}$ and $D^{2+}$ signify smaller fragments produced through cleavage of the cyclic precursor at two points along the peptide backbone. (B) MS/MS of precursor $1092.4^{3+}$ (3274.2 Da) (SEQ ID NO:1). (C) MS/MS of precursor $628.5^{3+}$ (1882.6 Da) (SEQ ID NO:2). (D) MS/MS of precursor 705.7$^{2+}$ (1409.4 Da) (SEQ ID NO:3). (E) Digestion scheme and mass of proteolytic fragments.
Figure 4:
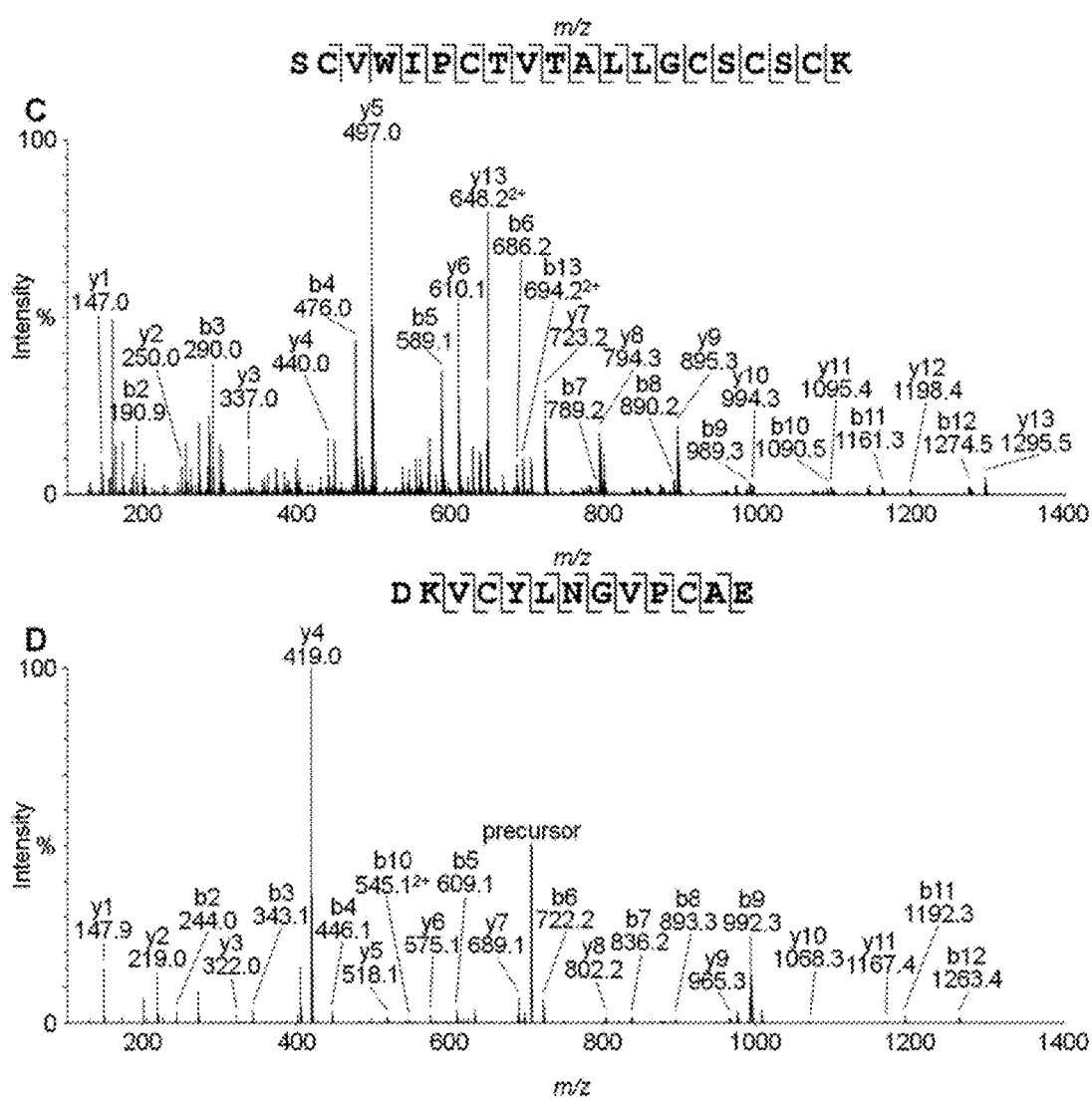
Figure 4:
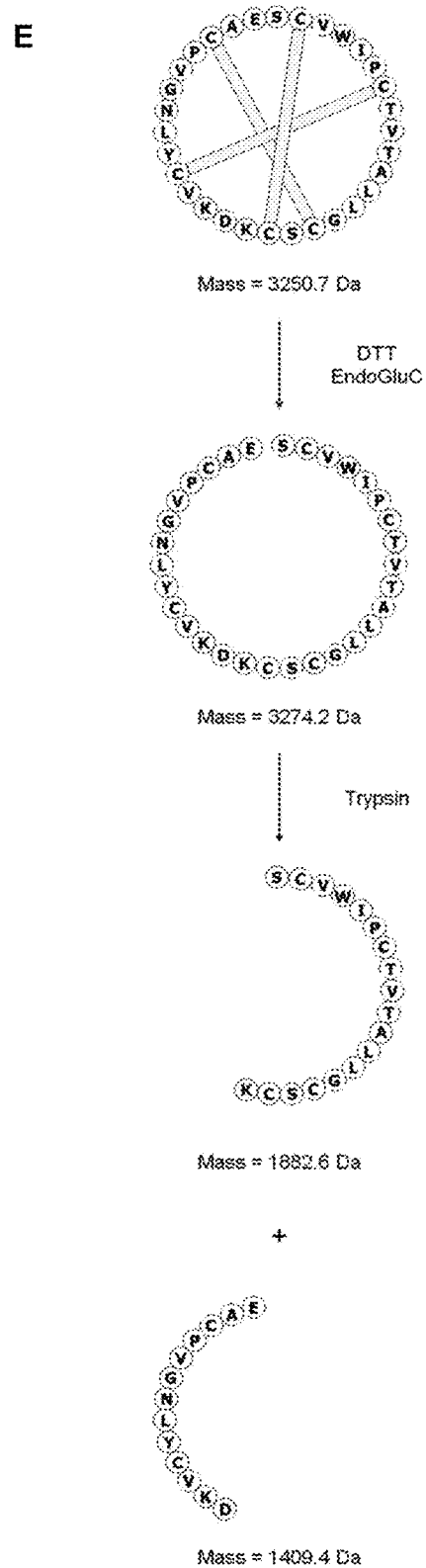

To illustrate the sequencing of the new cyclotides the step-by-step MS/MS analysis of Cter B is shown in FIG. 4. The linearized peptide resulting from endoproteinase Glu-C digestion of the reduced form of Cter B was analyzed via nanospray MS/MS. De novo sequencing yielded a tentative identification of SCVWIPCTVTALLGCSCKDKV-CYLNGVPCAE (SEQ ID NO:1). As indicated in FIG. 4B, sequence ion coverage permitted definitive assignment of the sequence near the termini of the peptide, but presented incomplete evidence for sequence close to the middle of the peptide, a feature observed in the analyses of many full-length linearized cyclotides. Combined trypsin and endoproteinase Glu-C digestion of reduced Cter B produced peptide fragments with complementary molecular weights of 1882.6 Da and 1409.4 Da. Complete sequence coverage for both precursors was attained in tandem MS analyses (FIGS. 4C and 4D), verifying the initial sequence assignment for the full-length linearized cyclotide. Using this approach, 12 novel cyclotides from *C. ternatea* were sequenced (see Table 1 in Example 1). Amino acid analyses were conducted to confirm the MS/MS determined sequences and to discriminate between Ile and Leu for a representative set of cyclotides, including Cter A, Cter B and C, Cter D and E, Cter F, and Cter G and Cter H.

Cyclotides are classified mainly into two subfamilies, Möbius or bracelet, based upon the presence or absence of a cis-Pro amide bond in loop 5. Cyclotides belonging to the bracelet subfamily are the most widely represented in the literature, at approximately three-fold greater incidence than cyclotides belonging to the Möbius subfamily. Consistent with this prominence, the sequences discovered in the current study, all belong to the bracelet subfamily. However, several of them have unusual residues at key processing sites, making them of interest for understanding processing mechanisms of cyclotides.

Figure 5:
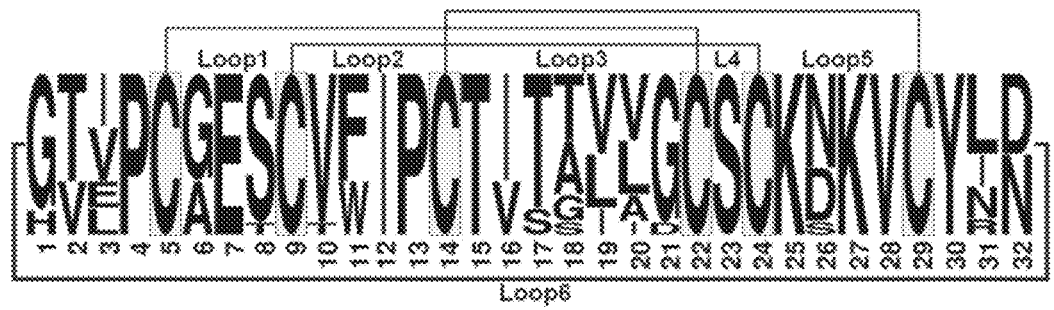
FIG. 5 provides a "sequence logo" relative frequency plot of the amino acids in the first 12 *C. ternatea* cyclotides listed in Table 1. Conserved residues among sequences include Pro4, CysS, Glu7, Cys9, Ile12, Pro13, Cys14, Thr15, Cys22, Ser23, Cys24, Lys25, Lys27, Val28, Cys29 and Tyr30.

An efficient way in which to describe and compare the features of cyclotides is by referring to the inter-cysteine loops, illustrated in FIG. 5 as an amino acid incidence plot for the 12 new sequences in sequence logo format (Crooks, G. E., et al., (2004), *Genome Res.* 14, 1188-1190). Most of the new cyclotides comprised combinations of known loops from previously characterized cyclotides, or novel loops with conservative amino acid substitutions. As a result, the majority of sequences displayed significant homology to known cyclotides. According to the sequence logo plot, the greatest variation in loop size and/or composition are in loops 3 and 6, consistent with data for all published cyclotide sequences as assessed using the 'cyclotide loop view' tool within Cybase (Kaas, Q., and Craik, D. J. (2010), *Peptide Sci.* 94, 584-591).

Biochemical Properties, of Novel Cyclotides.

Since the initial discovery of the insecticidal activity of cyclotides (Jennings, C., et al., (2001) *Proc. Natl. Acad. Sci. USA* 98, 10614-10619), several studies have demonstrated that this and other bioactivities are mediated through interactions with membranes (Barbeta, B. L., et al., (2008), *Proc. Natl. Acad. Sci. USA* 105:1221-1225). An important physicochemical feature of cyclotides, with regard to membrane interaction, is a surface-exposed patch of hydrophobic residues. This surface-exposure presumably results from the exclusion of hydrophobic amino acids from the core of cyclotides owing to the presence of the CCK motif. In addition to the importance of defined hydrophobic moieties in potentiating cyclotide-membrane interactions, clusters of charged residues have been demonstrated as determinants of hemolytic, insecticidal and anthelmintic activity. In particular, the hemolytic and anthelmintic properties of cyclotide variants correlate with these important structural features (Colgrave, M. L., et al., (2008) *ChemBioChem* 9, 1939-1945), with the most bioactive bracelet cyclotides displaying hydrophobic residues in loops 2 and 3, and positively charged residues in loops 5 and 6.

Among the novel Cter cyclotides identified here, Cter A has the largest net positive charge (2+) with basic residues clustered in loops 5 and 6, similar to the cycloviolacin peptides derived from *Viola odorata* that have been shown to possess potent anthelmintic activity (Colgrave, M. L., et al., (2008) *ChemBioChem* 9, 1939-1945; and Colgrave, M. L., et al., (2009), *Acta Trop.* 109, 163-166). The remaining peptides are clustered into groups with net positive 1+ (Cter G and Cter I), neutral (Cter B, Cter F, Cter H, Cter J and Cter K) and those with net negative charge –1 (Cter C, Cter E and Cter L). The bioactivities of cyclotides are further influenced by the manner in which they self-associate in membranes, which in turn is reliant upon the display of hydrophilic moieties on a 'bioactive face' spatially distinct from the hydrophobic patches (Huang, Y. H., et al., (2009) *J. Biol. Chem.* 284, 20699-20707, Huang, et al., (2010) *J. Biol. Chem.*; DOI: 10.1074/jbc.M109.089854). The proposed 'bioactive face' is centred around a glutamic acid residue, an absolutely conserved feature among previously reported cyclotides. Consistent with previous findings, this glutamic acid is conserved among all novel cyclotides described in this study.

Detection of N and D Peptide Isomers.

Figure 6:
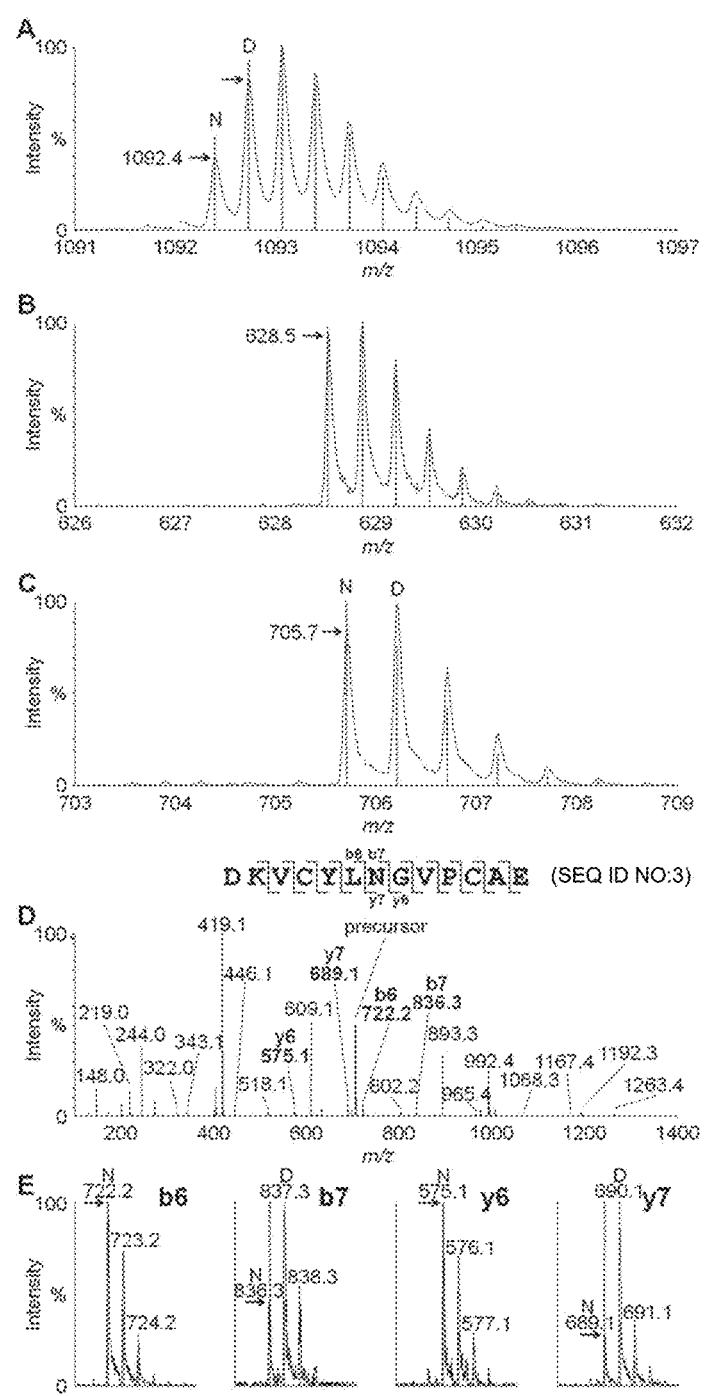
FIG. 6 shows isotopic distribution delineating isoform-specific sequence ions. Nanospray spectra for reduced and digested (trypsin and endoproteinase Glu-C) Cter B. (A) TOF-MS spectrum of full-length linearized Cter B-precursor 3274.2 Da. (B) TOF-MS spectrum of Cter B digest product with precursor 628.5$^{3+}$ (1882.6 Da). (C) TOF-MS spectrum of Cter B digest product with precursor 705.7$^{2+}$ (1409.4 Da). (D) Full product ion spectrum of precursor m/z 705.7$^{2+}$ (1409.4 Da). Sequence ions shown in bold represent cleavage of the amide bonds either side of the amino acid at position 7. (E) Isotopic distributions of diagnostic fragment ions b6, b7, y6 and y7 indicate the presence of both Asn and Asp at position 7 and thus the heterogeneous nature of the selected precursor ion within the transmission window. Dotted lines illustrate the theoretical isotopic distributions for precursor and fragment ions, assuming that the residue at position 7 is an asparagine. Arrows indicate the observed intensities of labelled monoisotopic peaks.
Figure 7:
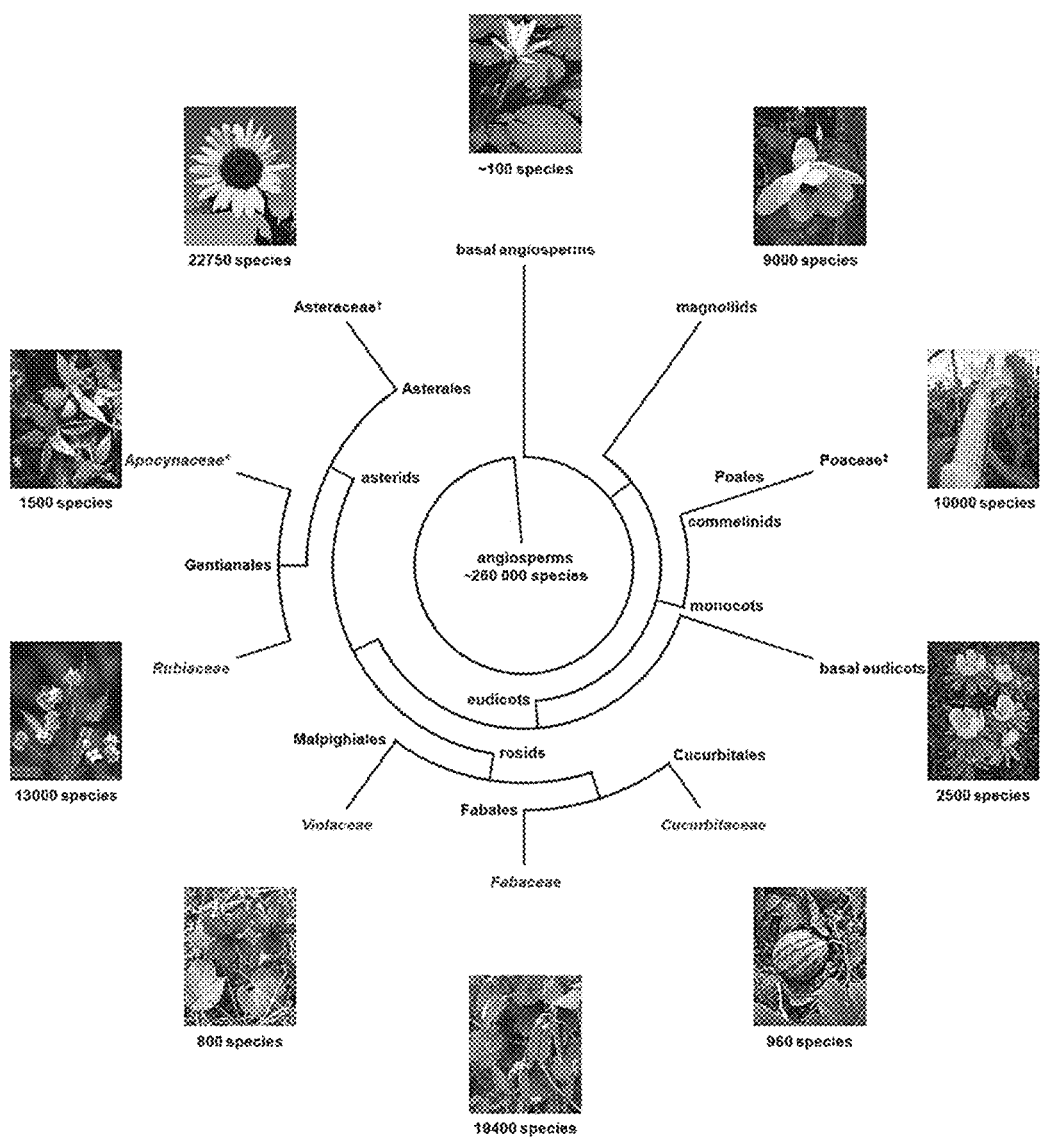
FIG. 7 illustrates distribution of ribosomally synthesized circular proteins within angiosperms. Cyclotide-containing plant families as reported in the literature appear in red italicized font. *A recent study reported evidence of cyclotides within the Apocynaceae family (Gruber, C. W., et al., (2008) Plant Cell 20, 2471-2483), but no cyclotide peptide or nucleic acid sequences have been published yet. ‡Gene sequences encoding putative linear cyclotide-like proteins have been identified in several species within the Poaceae family. (These sequences lack the C-terminal Asn or Asp considered crucial for in planta cyclization). †Backbone-cyclized circular peptides distinct from cyclotides have been characterized from species within the Asteraceae family.
Figure 8:
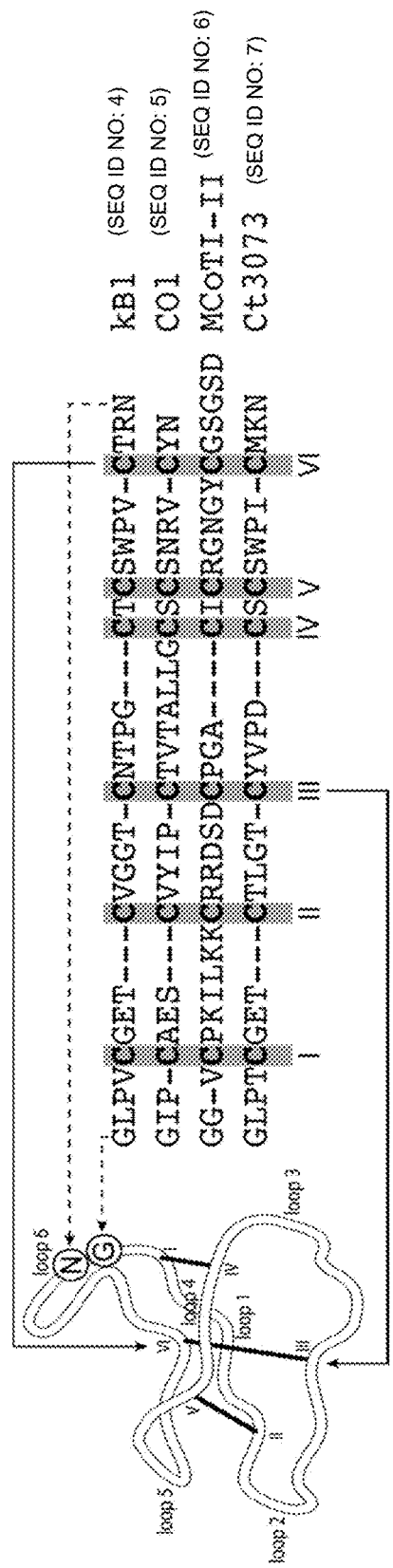
FIG. 8 provides a sequence alignment of the prototypical cyclotide kalata B1 (kB1) from the Rubiaceae plant *Oldenlandia affinis* with other selected cyclotide sequences. The six conserved cysteine residues are labeled with Roman numerals and various loops in the backbone between these cysteines are labeled loops 1-6. The cystine knot arrangement is indicated. The sequences of kalata B1 (SEQ ID NO:4, Saether, O., et al. (1995) *Biochemistry* 34:4147-4158), cycloviolacin O2 (SEQ ID NO:5, Craik, D. J., et al., (1999) *J Mol Biol* 294:1327-1336), MCoTI-II (SEQ ID NO:6, Hernandez J.-F., et al. (2000) *Biochemistry* 39:5722-5730) and Cter A (SEQ ID NO:7, Poth, A. G., et al., (2011) *ACS Chem. Biol.* 10.1021/cb100388j) represent examples of cyclotides isolated from the Rubiaceae, Violaceae, Cucurbitaceae and Fabaceae plant families. The conserved cysteines are boxed and their location on the structure is indicated by the dotted arrows. The putative processing points by which mature cyclotides are excised from their precursor proteins are indicated and correspond to an N terminal glycine residue and a C terminal Asn (N) or Asp (D) residue. PDB ID code for kalata B1 is 1NB1.
Figure 12:
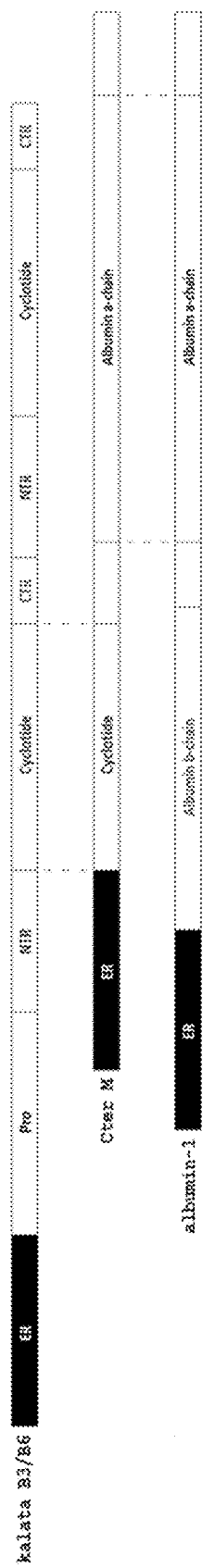
FIG. 12 compares the gene structures for an exemplary kalata cyclotide gene from *O. affinis* (encoding kB3/6), the gene encoding the Cter M cyclotide isolate from *C. ternatea*, and the *Pisum savitum* albumin-1 gene.

Mass spectrometric analyses of a majority of isolated *C. ternatea* cyclotides generated peptide ions with ambiguous isotope patterns. The isotopic distributions of full-length linearized Cter B, as well as fragment peptides produced from dual enzyme digests of Cter B are shown in FIG. 6. As illustrated in panel A, the measured intensity of the monoisotopic peak at m/z 1092.4 relative to the rest of the isotopic envelope for full-length linearized Cter B is less than the theoretical intensity (indicated by dashed lines). Panel B demonstrates that the experimental and calculated isotopic distributions for the triply charged precursor at m/z 628.5 corresponding to the sequence SCVWIPCTVTALLGCSCK (SEQ ID NO:2) match closely, whereas the experimental and calculated isotopic distributions for the doubly charged precursor at m/z 705.7 (panel C) corresponding to the sequence DKVCYLNGVPCAE (SEQ ID NO:3) are clearly different. These mass spectral data indicate that multiple full-length cyclotide precursors are present in the sample, and that the variable isotopic distributions observed among the precursor ions are associated with the cyclotide fragment corresponding to m/z 705.7.

Subsequent tandem MS analysis of the m/z 705.7 fragment was conducted to determine the point of variation in the peptide sequence. Panel D shows the tandem MS spectrum of the m/z 705.7 precursor, with diagnostic sequence ions indicated in bold. In panel E the b6 (DKVCYL (SEQ ID NO:132), m/z 722.2) and y6 (GVPCAE (SEQ ID NO:133), m/z 575.1) ions exhibit typical isotopic distributions for their size, with the monoisotopic peak appearing as the most intense and with isotopic patterns matching closely with the theoretical patterns. The distributions for b7 (DKVCYLN (SEQ ID NO:134), m/z 836.3) and y7 (NGVPCAE (SEQ ID NO:135), m/z 689.1) ions, however, are skewed such that the most intense peak within their respective isotopic envelopes is that which normally corresponds to the monoisotopic peak of an analyte bearing a single $^{13}C$ atom. The fact that the peptide fragments in question are too small for this to be the case, along with the abrupt deviations in isotopic distribution from adjacent sequence ions, suggests the co-existence of peptides with an Asn or Asp at position 7 within the m/z 705.7 fragment, i.e., DKVCYLNGVPCAE (SEQ ID NO:3) and DKVCYLDGVPCAE (SEQ ID NO:136), corresponding to position 31 in the sequence of Cter B shown in Table 1. Of the C. ternatea cyclotides listed in Table 1, five pairs of sequences appear to be related through dual-isotope patterns of this nature, i.e. Cter B and C; Cter D and E; Cter G and H; Cter I and J; and Cter K and L.

In the initial report detailing the discovery of cyclotides from Viola odorata (Craik, D. J., et al., (1999) J. Mol. Biol. 294, 1327-1336), the reported cyclotides, named cycloviolacins, all possessed an Asn in loop 6 corresponding to the C-terminus of linear precursor proteins. Subsequent examination of V. odorata using modified HPLC conditions (Ireland, D. C., et al., (2006) Biochem. J. 400, 1-12) uncovered a range of novel cyclotides. The novel peptides included cycloviolacin O19 and cycloviolacin O20, whose sequences are highly homologous to those of previously reported cyclotides cycloviolacin 08 and cycloviolacin O3, respectively. Cycloviolacin O19 and cycloviolacin O20 possess a loop 6 Asp, in the place of Asn, and were not reported in the earlier study (Craik, D. J., et al., (1999) J. Mol. Biol. 294, 1327-1336). The study by Ireland et al. therefore provided the first evidence for the existence of Asn and Asp C-terminal cyclotide isoforms in V. odorata, indicating that highly homologous cyclotides differing by a C-terminal Asn or Asp, or other single amino acid substitutions co-elute during standard HPLC separations. Given that most cyclotide separations reported in the literature have relied on these standard HPLC conditions, it is likely that in these studies, cyclotides with C-terminal Asn and Asp co-eluted, thus eluding analysis.

MS analysis demonstrates that Asn and Asp variants can be identified in a mixture through careful scrutiny of MS data. Furthermore, this study suggests that cyclotides with C-terminal Asp might be more common than previously reported, being missed in earlier MS analyses. The possibility also exists that cyclotides differing by 1 Da but whose sequences are homologous such as those that would result from the differential incorporation of Gln or Glu, or those that differ at a range of positions may co-elute.

N and D Peptide Isomers Exist Naturally in Planta.

Of the more than 150 cyclotides characterized previously, only four pairs share sequences otherwise identical to each other apart from Asn and Asp variation in loop 6, i.e., kalata B1 and B4, kalata B6 and B10, cycloviolacin O8 and O19, and cycloviolacin O3 and O20 (Kaas, Q., and Craik, D. J. (2010), Peptide Sci. 94, 584-591). Therefore, the high incidence of Asn and Asp variants warranted further examination to rule out deamidation as a possible cause of the synonymous sequences. Deamidation of Asn residues during sample workup is a commonly observed artefact in proteomic analyses, catalysed by exposure of the sample to elevated temperatures and basic pH (Wright, H. T. (1991), Crit. Rev. Biochem. Mol. Biol. 26, 1-52), typically during enzymatic cleavage, and occurring most frequently at Asn residues immediately N-terminal to Gly, as would be the case in these cyclic proteins. However, the isotopic distributions of 'native' cyclotides extracted from fresh plant material at low pH and not heated before MS analysis suggest that Asn and Asp cyclotide variants described, e.g., Cter B and C; Cter D and E; Cter G and H; Cter I and J; and Cter K and L, co-exist naturally. The existence of Cter A and Cter F, which do not display 'Asn or Asp variability' and which were isolated from the same starting material and processed in parallel supports the natural co-existence of Asn and Asp C-terminal cyclotide isoforms.

A recent study of ESTs from the cyclotide-producing plant O. affinis reports high relative expression of a protein with close homology to asparaginase, whose biological function is the conversion of asparagine to aspartic acid (Qin, Q., et al., (2010) BMC Genomics 11, DOI: 10.1186/1471-2164-11-111). With respect to pairs of cyclotides isolated from O. affinis differing only at the nascent C-terminus, the fact that only kalata B1 and kalata B6 (C-terminal Asn) genes have been found despite peptide evidence for kalata B1 and B4, and kalata B6 and B10 (each pair identical except for C-terminal Asn or Asp), led Qin et al. to suggest the alternative possibility that the 'Asp' peptides are a product of post-translational processing occurring in planta (Qin 2010, supra). A similar situation exists for related V. odorata peptides cycloviolacin O8 (C-terminal Asn) and cycloviolacin O19 (C-terminal Asp), with only the gene encoding the former cyclotide having been characterized (Dutton, J. L., et al., (2004) J. Biol. Chem. 279, 46858-46867). However, it remains to be determined whether the observed 'Asn or Asp' variable peptide pairs from O. affinis and V. odorata are a product of enzymatic post-translational processing, and further, whether a similar enzyme is involved in the biosynthesis of some metabolites with C-terminal Asp described from C. ternatea in this study.

Variable Residues in the Ligation Site Imply Catalytic Promiscuity.

Since the discovery of the first cyclotide-encoding gene, it has been evident that amino acids participating in cyclization are located in loop 6 of fully-formed cyclotides. Recent studies exploring the structural characteristics of cyclotide precursor sequences involved in their cyclization (Gillon, A. D., et al., (2008) Plant J. 53, 505-515; Saska, I., et al., (2007) J. Biol. Chem. 282, 29721-29728) emphasize the importance of tripeptide motifs (typically Gly-Leu-Pro or Ser-Leu-Pro or Ala-Leu-Pro) demarcating the cyclotide domain, and the positioning of an Asn or Asp residue immediately prior to the C-terminal tripeptide. In addition, these studies suggest that an as yet unidentified asparaginyl endopeptidase (AEP) is responsible for the ligation of cyclotide proto-termini as the final step of cyclotide biosynthesis.

Among the cyclotides encoded by the genes provided herein, Cter G and Cter H, and Cter K and Cter L contain novel amino acid sequences at their respective predicted sites of in planta cyclization. In the case of Cter G and Cter H, the loop 6 sequences 'YNNGLP' (SEQ ID NO:137) and 'YNDGLP' (SEQ ID NO:117) present the unique motifs Asn-Asn-Gly and Asn-Asp-Gly, which are noteworthy because they present two possible cyclization sites. The position of the peptide bond formed during cyclization of linear cyclotide precursors, as corroborated by gene sequencing efforts, is frequently observed at an Asn-Gly or the Asp-Gly junction. By itself, this information would suggest that the cyclization site in Cter H is Asp-Gly; however, the demonstrated cyclic nature of cycloviolacin O25 (Ireland, D. C., et al., (2006) *Biochem. J.* 400, 1-12), which presents a loop 6 sequence 'YFNDIF' (SEQ ID NO:138), tenders the alternative possibility that the cyclization reaction takes place between Asn-Asp. In the case of Cter K and Cter L, the loop 6 sequences are 'YNHEP' (SEQ ID NO:139) and 'YDHEP' (SEQ ID NO:140) with presumed novel cyclization sites Asn-His or Asp-His. Although there are other examples of cyclotides with a positively charged residue following Asp in the cyclization site (for example 'YHDKIP' (SEQ ID NO:141) in circulin D and circulin E) (Gustafson, K. R., et al., (2000) *J. Nat. Prod.* 63, 176-178), this is the first example with an acidic residue in place of the typically small hydrophobic residue (Ala, Ile, Leu or Val) at this position (second residue of mature cyclotide in presumed gene sequence). The existence of mature cyclic peptides with unusual residues within the N-terminal tripeptide motif (e.g. HEP in Cter K and Cter L) suggests greater flexibility in cyclotide processing mechanisms within *C. ternatea* than observed in other cyclotide-producing species. A recent study in which a modified cyclotide gene was expressed in transgenic non-cyclotide-containing plant species reported that mechanisms central to the processing of fully-formed cyclotides are sensitive to changes in N-terminal sequence. In particular, Ala mutations at $Gly_1$ or $Leu_2$ in kalata B1 genes were found to disrupt the formation of cyclic products (Gillon, A. D., et al., (2008) *Plant J.* 53, 505-515).

Legumain, an AEP with transpeptidation (peptide ligation) activity, first described in jack beans (Carrington, D. M., et al., (1985) *Nature* 313, 64-67, Min, W., and Jones, D. H. (1994) *Nat. Struct. Biol.* 1, 502-504), is of potential significance to the processing of cyclotides. In particular, the demonstrated flexibility of a Fabaceae legumain that cleaves at almost all Asn-Xaa bonds (Abe, Y., et al., (1993) *J. Biol. Chem.* 268, 3525-3529) and to a lesser extent Asp-Xaa bonds (Halfon, S., et al., (1998) *FEBS Lett.* 438, 114-118) may prove to be relevant in the biosynthesis of cyclotides from *C. ternatea*. Among the Fabaceae cyclotides investigated in the current study, those with non-typical sequence in loop 6 including 'YNHEP' (SEQ ID NO:139) or 'YDHEP' (SEQ ID NO:140) in Cter K and Cter L, and 'YNNGIP' (SEQ ID NO:141) or 'YNDGIP' (SEQ ID NO:142) in Cter G and Cter H were all observed as fully cyclized gene products.

Besides *C. ternatea* cyclotides possessing novel loop 6 sequences, there are a number of 'orphan' cyclotides whose loop 6 sequences appear incompatible with the typical activity of AEPs previously implicated in cyclotide bioprocessing. Apart from cycloviolacin O25, whose loop 6 sequence indicates the lack of typical putative N-terminal amino acids Gly, Ser or Ala in putative precursors, *Chassalia parvifolia* cyclotides circulin D and circulin E are distinct from other known cyclotides in that they have positively charged proto-N-termini, whereas circulin F does not have an Asn or Asp in loop 6. Cyclization by AEP is one of the proposed biosynthetic mechanisms proposed as being central to the cyclization of SFTI-1 (Mulvenna, J. P., et al., (2005) *J. Biol. Chem.* 280, 32245-32253) in *Helianthus annuus*, however the gene sequence corresponding to amino acids surrounding the expressed protein sequence does not indicate the involvement of Gly-Leu-Pro tripeptide motifs regarded as essential in cyclotide precursor proteins (Gillon, A. D., et al., (2008) *Plant J.* 53, 505-515; Saska, I., et al., (2007) *J. Biol. Chem.* 282, 29721-29728). In addition, sequence alignments of cyclic trypsin inhibitors MCoTI-1 and MCoTI-II from *Momordica cochinchinensis* with related linear trypsin inhibitors (Hernandez, J.-F., et al., (2000) *Biochemistry* 39, 5722-5730 suggest that they exhibit C-terminal Gly as unprocessed precursor proteins. Therefore, it is tempting to speculate that cyclization strategies utilized by organisms in the production of cyclotides and other cyclic proteins vary between species, based in part upon the capabilities of available processing enzymes.

The amino acid sequence of cyclotide Cter M (FIG. 9), while bearing the classic hallmark of other cyclotides, including the spacing of the six conserved Cys residues and a CCK fold, as determined by NMR, has some sequence differences that suggest a greater flexibility in cyclotide processing than has hitherto been reported. Its conserved Asn residue at the C-terminus of the mature cyclotide domain suggests processing by AEP like other cyclotides but the residue immediately following this Asn in the Cter M precursor, His, has not been seen in any other cyclotide genes, which exclusively contain a small amino acid (usually Gly or Ala at this position).

Fabaceae Cyclotide Gene Organization

All cyclotides reported to date from other plant families are biosynthesized from precursor proteins that are encoded by dedicated genes. In contrast, the cyclotides of *C. ternatea* are expressed from genes having a markedly different configuration.

The gene encoding the Cter M cyclotide is shown in FIG. 10. In contrast to the configuration seen other plant families, the gene in *C. ternatea* encodes a precursor that comprises the cyclotide amino acid sequence along with an albumin subunit sequence. While not limiting the present invention to any particular model, the cyclotide gene encoding Cter Mappears to have hijacked an albumin gene, encoding the cyclotide in place of subunit b of the albumin. Pea albumin 1 subunit b (PA1b) is a 37-amino acid protein isolated from pea seeds (*Pisum sativum*), that has been shown to act as a potent insecticidal agent (Da Silva, P., et al., (2010) *J Biol Chem* 285, 32689-32694). See also Nguyen, et al. *J. Biol. Chem.* 286(27):24275-87 (2011), incorporated herein by reference for all purposes. PA1b is characterized as a knottin owing to the three braced disulfide bonds. In an analogous fashion to the cyclotide kalata B1 (Simonsen, S. M., et al., (2008) *J Biol Chem* 283, 9805-9813), the three-dimensional structure of PA1b has been demonstrated to be extremely tolerant to modifications (Da Silva, supra). Furthermore, both receptor-binding and insecticidal activities of PA1b were dependent on a cluster of hydrophobic residues located on a single face of the molecule (Da Silva, supra). These data show striking parallels with recent studies highlighting the importance of the hydrophobic patch of kalata B1 in modulating insecticidal and membrane binding interactions (Simonsen, supra, Huang, Y. H., et al., (2009) *J Biol Chem* 284, 20699-20707).

The current study shows that fully folded cyclotides are produced naturally in a member of the Fabaceae plant family, demonstrating both the presence and capabilities of necessary post-translational modification infrastructure involved in their biosynthesis. Although the sequences of novel cyclotides described in this study are mostly conservative permutations of previously identified proteins, the sequence variability displayed at putative cyclization sites in a number of *C. ternatea* cyclotides suggests that alternative biosynthetic cyclization mechanisms may be responsible. In particular, cyclotides described in this study possessing novel putative N-termini are suggestive of significantly different, or additional specialized capabilities with respect to enzymes supporting their cyclization. Numerous species within the Fabaceae are known to possess legumain, an AEP which was initially discovered as the enzyme responsible for peptide ligation in the post-translational processing of the lectin concanavalin A from *Canavalia ensiformis* (Jackbean) seeds (Carrington, D. M., et al., (1985) Nature 313, 64-67) If a homologous enzyme exists in *C. ternatea*, its presence could explain the existence of cyclotides with unusual sequence at their putative cyclization sites characterized described in the current study, as legumain activity has been reported across a wide range of Asn-Xaa bonds (Abe, Y., et al., (1993) *J Biol Chem* 268, 3525-3529).

These considerations, coupled with the importance of Fabaceous crops to nutrition, industry and agriculture, give Fabaceae species special relevance in future cyclotide-focused transgenic studies. Cyclotides have been previously exploited as ultra-stable scaffolds for the presentation of bioactive epitopes (Gao, Y., et al., (2010) *Bioorg Med Chem* 18, 1331-1336; Gunasekera, S., et al., (2008) *J Med Chem* 51, 7697-7704; Thongyoo, P., et al., (2009) *J Med Chem* 52, 6197-6200). Fabaceae plants represent novel vectors for biotechnological production of a broader range of designer cyclic proteins than previously considered possible. The demonstrated capacity of *C. ternatea* to produce fully formed cyclotides suggests that cyclotides with optimized resistance traits and/or possessing other traits of pharmaceutical, economic or agricultural significance may be readily expressed in a functional form within Fabaceae species. Due to the previously demonstrated efficacy of naturally occurring cyclotides as insecticidal (Barbeta, B. L., et al. (2008) *Proc. Nat'l. Acad. Sci. USA* 105, 1221-1225, Jennings, C., et al., (2001) *Proc. Nat'l. Acad. Sci. USA* 98, 10614-10619) and nematocidal (Colgrave, M. L., et al., (2008) *Biochemistry* 47, 5581-5589, Colgrave, M. L., et al., (2008) *Chembiochem* 9, 1939-1945, Colgrave, M. L., et al., (2009) *Acta Trop* 109, 163-166, and Colgrave, M. L., et al., (2010) *Antimicrob Agents Chemother* 54, 2160-6) agents, it is believed that the natural role of cyclotides is as plant defence agents, making them excellent candidates for incorporation in transgenic crops to provide resistance against important pests.

Cyclotides are known to possess potent in vitro anthelmintic activity against human, canine and ovine nematode parasites. Root-knot nematodes, which are estimated to cause more than $100 billion of crop losses worldwide (Koenning, S. R., et al., (1999) *J Nematol* 31, 587-618, Opperman, C. H., et al., (2008) *Proc Natl Acad Sci USA* 105, 14802-14807) represent obvious targets in this regard, however the efficacy of cyclotides against them remains untested. Cyclotides are differentially expressed among plant tissues, presumably in order to counter the selective pressures specific to their respective microenvironments (Trabi, M. & Craik, D. J. (2004) Plant Cell 16, 2204-2216). Cyclotide Vhr-1 from *Viola hederacea* is expressed exclusively in the root tissue of *Viola hederaceae*.

The present invention contemplates linear molecules of from about 20 amino acids to about 100 amino acids and more preferably from about 25 amino acids to about 50 amino acids such as about 30 amino acids which are used as substrates for cyclization reactions. The resulting cyclized molecules having the same or functionally similar structure as the cyclic framework as herein described.

As stated above, the present invention extends to a range of derivatives, homologues and analogues of the molecular framework. A derivative includes parts, fragments, portions and linear forms. One particularly useful linear form is referred to herein as "uncycles" which are acyclic permutations of the cyclic molecular framework. Circular permutation involves the synthesis or expression of proteins having amino- and carboxy-termini permuted from their native locality. In relation to the naturally occurring cyclic molecular frameworks of the present invention, such molecules do not have native amino and carboxy termini. However, cyclic permutation permits a range of different linear molecules to be prepared with different amino and carboxy termini. An uncycle may have increased activity relative to its cyclic form or no activity or may exhibit antagonist activity. An uncycle exhibiting no activity may nevertheless be useful, for example, in the generation of antibodies.

By way of example only, particularly preferred CCK molecules comprise six cysteine residues and, hence, have six loops in the backbone which can be opened to form six possible topologically distinct acyclic permutants. Similarly, each of the 6 linear topologies may also be cyclized. This aspect of the present invention provides, therefore, for the cyclization of any linear topology into a CCK framework.

The uncycles of the present invention may be useful as antagonists of the cyclic molecular framework or may themselves exhibit useful activity.

Still another aspect of the present invention is directed to antibodies to the molecular framework of the present invention. Such antibodies may be monoclonal or polyclonal. Polyclonal antibodies are particularly preferred. Antibodies may be made using standard techniques.

The cyclic molecular frameworks according to the present invention are useful as therapeutic agents in animals and as anti-pathogenic agents in plants. Accordingly, the present invention provides a method for the treatment or prophylaxis of conditions or diseases in mammals, preferably humans, including the step of administering a molecular framework as hereinbefore described either without modification or having heterologous amino acids grafted thereon.

In particular, molecular frameworks may be selected or engineered for use in the treatment of neurological disorders such as acute and chronic pain, stroke, traumatic brain injury, migraine, epilepsy, Parkinson's disease, Alzheimer's disease, multiple sclerosis, schizophrenia and depression as well as cystic fibrosis and/or other respiratory diseases. The molecular framework may also be selected to treat plants against pathogen infestation and mammals including humans from viral or microbial infection.

The present invention also provides a composition comprising cyclic molecular framework molecules as hereinbefore described and a pharmaceutically acceptable carrier and/or diluent. Preferably the composition is in the form of a pharmaceutical composition.

There is also provided the use of a cyclic molecular framework in the manufacture of a medicament for the treatment or a prophylaxis of diseases or other conditions in mammals, preferably in humans.

In some embodiments, a transgenic plant is produced comprising cells transformed with at least one gene encoding the CterM or CterM-like gene described above, such that a cyclotide is expressed in at least one of its tissues of organs. The present invention encompasses transgenic plants produced in this way to express CterM or CterM-like peptides (without or without heterologous grafted peptides) in any of Fabaceae and/or non-Fabaceae plants of agricultural and biotechnological significance. These plants can be obtained by conventional techniques of plant transgenesis as are presently well known and which have been rigourously tested in these many plant species (see, e.g., Dunwell, J. M. (2000). *J. Exp. Biol.* 51, 487-496; and Eapen, S. (2008) *Biotechnol. Adv.* 26, 162-168).

Genetic elements typically or optionally included for expression of heterologous proteins in plants are known in the art. For example, binary vectors, for plant transformation are generally configured to allow propagation in multiple host cell types, may typically contain an origin of replication, a selectable marker gene cassette with appropriate promoter, multiple cloning sites in which the gene of interest and/or reporter gene can be inserted, and T-DNA borders (e.g., as reviewed by Komari, T., et al., (2006) Binary Vectors and super-binary vectors. pp. 15-42. In: *Agrobacterium* Protocols. Ed, Kan Wang. *Methods in Molecular Biology* Volume 343). The vector backbone may also include a bacterial selectable marker gene unit, plasmid mobilization functions and plasmid replication functions, as well other factors relevant to plasmid mobilization and replication in, e.g., *Agrobacterium*. Examples include pCAMBIA series (see, e.g., the cambia.org site on the world wide web) and pPZP series (Hajdukiewicz, et al., (1994) The small, versatile pPZP family of *Agrobacterium* binary vectors for plant transformation. *Plant Mol. Biol.* 25, 989-994.). In some embodiments, binary vectors are used in conjunction with helper plasmids that provide one or more functions, e.g., for replication.

Methods of transformation of plant cells are known in the art. Commonly used methods typically comprise *Agrobacterium*-mediated transformation. See e.g., Eapen S, et al., (1987) Cultivar dependence of transformation rates in mothbean after co-cultivation of protoplasts with *Agrobacterium tumefaciens. Theor Appl Genet.* 75: 207-10; Krishnamurthy K V, et al., (2000) *Agrobacterium* mediated transformation of chickpea (*Cicer arietinum* L.) embryo axes. *Plant Cell Rep* 19: 235-40; and Sharma K K, et al., (2006) *Agrobacterium*-mediated production of transgenic pigeonpea (*Cajanus cajan* L Millsp) expressing synthetic Bt cryIAb gene. *In vitro Cell Dev Biol Plant* 42: 165-73. In *Agrobacterium*-mediated transformation, embryonic axes and cotyledonary nodes are most commonly used as explants, although shoot apices, leaf, callus, seed, stem segments or other plant tissues are also used. Other transformation techniques that find use with the present invention include but are not limited to particle gun bombardment (e.g., Kamble S, et al., (2003) A protocol for efficient biolistic transformation of mothbean (*Vigna aconitifolia* L. Marechal). *Plant Mol Biol Report* 21: 457a-j; Indurker S, et al., (2007) *Plant Cell Rep* 26: 755-63), electroporation of intact axillary buds (Chowrira G M, et al., (1996) *Mol Biotechnol* 5:85-96) and electroporation-PEG mediated transformation using protoplasts (Kohler F, et al., (1987a) *Plant Cell Rep* 6: 313-7 and Kohler F, et al., (1987b) *Plant Sci Lett* 53: 87-91.). Techniques used may vary according to the transgenic plant species to be generated. Plant regeneration is generally by de novo organogenesis, although somatic embryogenesis or proliferation of shoot meristems from areas surrounding a shoot bud are also options.

Transformation of plants may be assessed by a number of different methods. For example, plant tissues may be assessed for the presence of the gene of interest, or an RNA or protein produced therefrom, by standard hybridization, antibody, or other functional tests that are standard in the art. Further, selectable markers may be used to confirm transformation. For example selectable markers may include neomycin phosphotransferase (nptII) gene (Valvekens et al., (1988) *Proc. Natl. Acad. Sci. USA* 85: 5536-5540) and/or Phosphomannose isomerase (Boscariol et al., (2003) *Plant Cell Rep* 22, 122-128), which confer resistance to antibiotics (kanamycin, paromomycin), and eliminate natural plant toxicity to mannose, respectively. The selection of a particular selectable marker for use is typically based upon plant species to be transformed and downstream applications for which the transformed cells or tissues will be used (e.g., toxicity studies).

Numerous diverse plant species have been genetically transformed with foreign DNA, using several different gene insertive techniques. In some embodiments edible plants may be selected for expression of cyclotides such that the cyclotide (e.g., a cyclotide having nutrient or therapeutic function or activity) may be delivered to a subject in an edible material. In such embodiments, the host plant selected for genetic transformation preferably has edible tissue in which the cyclotide is expressed, such as the fruit, leaves, stems, sees, or roots, such that the tissue may be consumed by a human or an animal for whom the cyclotide is intended. For example, the Fabaceae family of plants comprises soy plants (e.g., *Glycine max*), which contains edible seeds and tissues, and from which numerous edible materials may be produced. A cyclotide may also be produced in a non-edible plant and may be isolated and used or administered in standard fashion such as may be used for any agricultural, pharmaceutical or nutrient substance or chemical.

As will be readily appreciated by those skilled in the art, the route of administration and the nature of the pharmaceutically acceptable carrier will depend on the nature of the condition and the mammal to be treated. It is believed that the choice of a particular carrier or delivery system, and route of administration could be readily determined by a person skilled in the art. In the preparation of any formulation containing the peptide actives care should be taken to ensure that the activity of the framework is not destroyed in the process and that the framework is able to reach its site of action without being destroyed. In some circumstances it may be necessary to protect the framework by means known in the art, such as, for example, micro encapsulation. Similarly the route of administration chosen should be such that the peptide reaches its site of action. In view of the improved stability and/or bioavailability of the cyclic frameworks relative to their "linear" counterparts, a wider range of formulation types and routes of administration is available.

The pharmaceutical forms suitable for injectable use include sterile injectable solutions or dispersions, and sterile powders for the extemporaneous preparation of sterile injectable solutions. They should be stable under the conditions of manufacture and storage and may be preserved against the contaminating action of microorganisms such as bacteria or fungi. The solvent or dispersion medium for the injectable solution or dispersion may contain any of the conventional solvent or carrier systems for peptide actives, and may contain, for example, water, ethanol, polyol (for example, glycerol, propylene glycol and liquid polyethylene glycol, and the like), suitable mixtures thereof, and vegetable oils. The proper fluidity can be maintained, for example, by the use of a coating such as lecithin, by the maintenance of the required particle size in the case of dispersion and by the use of surfactants. The prevention of the action of microorganisms can be brought about where necessary by the inclusion of various antibacterial and antifungal agents, for example, parabens, chlorobutanol, phenol, sorbic acid, thimerosal and the like. In many cases, it will be preferable to include agents to adjust osmolality, for example, sugars or sodium chloride. Preferably, the formulation for injection will be isotonic with blood. Prolonged absorption of the injectable compositions can be brought about by the use in the compositions of agents delaying absorption, for example, aluminum monostearate and gelatin. Pharmaceutical forms suitable for injectable use may be delivered by any appropriate route including intravenous, intramuscular, intracerebral, intrathecal injection or infusion.

Sterile injectable solutions are prepared by incorporating the active compounds in the required amount in the appropriate solvent with various of the other ingredients enumerated above, as required, followed by filtered sterilization. Generally, dispersions are prepared by incorporating the various sterilized active ingredients into a sterile vehicle which contains the basic dispersion medium and the required other ingredients from those enumerated above. In the case of sterile powders for the preparation of sterile injectable solutions, the preferred methods of preparation are vacuum drying and the freeze-drying technique which yield a powder of the active ingredient plus any additional desired ingredient from previously sterile-filtered solution thereof.

When the active ingredient is suitably protected, it may be orally administered, for example, with an inert diluent or with an assimilable edible carrier, or it may be enclosed in hard or soft shell gelatin capsule, or it may be compressed into tablets, or it may be incorporated directly with the food of the diet. For oral therapeutic administration, the active compound may be incorporated; with excipients and used in the form of ingestible tablets, buccal tablets, troches, capsules, elixirs, suspensions, syrups, wafers, and the like. Such compositions and preparations preferably contain at least 1% by weight of active compound. The percentage of the compositions and preparations may, of course, be varied and may conveniently be between about 5 to about 80% of the weight of the unit. The amount of active compound in such therapeutically useful compositions is such that a suitable dosage will be obtained.

The tablets, troches, pills, capsules and the like may also contain the components as listed hereafter. A binder such as gum, acacia, corn starch or gelatin; excipients such as dicalcium phosphate; a disintegrating agent such as corn starch, potato starch, alginic acid and the like; a lubricant such as magnesium stearate; and a sweetening agent such a sucrose, lactose or saccharin may be added or a flavouring agent such as peppermint, oil of wintergreen, or cherry flavouring. When the dosage unit form is a capsule, it may contain, in addition to materials of the above type, a liquid carrier. Various other materials may be present as coatings or to otherwise modify the physical form of the dosage unit. For instance, tablets, pills, or capsules may be coated with shellac, sugar or both. A syrup or elixir may contain the active compound, sucrose as a sweetening agent, methyl and propylparabens as preservatives, a dye and flavouring such as cherry or orange flavour. Of course, any material used in preparing any dosage unit form should be pharmaceutically pure and substantially non-toxic in the amounts employed. In addition, the active compound(s) may be incorporated into sustained-release preparations and formulations.

The present invention also extends to any other forms suitable for administration, for example, topical application such as creams, lotions and gels, or compositions suitable for inhalation or intranasal delivery, for example solutions or dry powders.

Parenteral dosage forms are preferred, including those suitable for intravenous, intrathecal, or intracerebral delivery.

Pharmaceutically acceptable carriers and/or diluents include any and all solvents, dispersion media, coatings, antibacterial and antifungal agents, isotonic and absorption delaying agents and the like. The use of such media and agents for pharmaceutical active substances is well known in the art. Except insofar as any conventional media or agent is incompatible with the active ingredient, use thereof in the therapeutic compositions is contemplated. Supplementary active ingredients can also be incorporated into the compositions.

It is especially advantageous to formulate parenteral compositions in dosage unit form for ease of administration and uniformity of dosage. Dosage unit form as used herein refers to physically discrete units suited as unitary dosages for the mammalian subjects to be treated; each unit containing a predetermined quantity of active material calculated to produce the desired therapeutic effect in association with the required pharmaceutical carrier. The specification for the novel dosage unit forms of the invention are dictated by and directly dependent on (a) the unique characteristics of the active material and the particular therapeutic effect to be achieved, and (b) the limitations inherent in the art of compounding such an active material for the treatment of disease in living subjects having a diseased condition in which bodily health is impaired as herein disclosed in detail.

The principal active ingredient is compounded for convenient and effective administration in effective amounts with a suitable pharmaceutically acceptable carrier in dosage unit form. A unit dosage form can, for example, contain the principal active compound in amounts ranging from 0.25 µg to about 2000 mg. Expressed in proportions, the active compound is generally present in from about 0.25 µg to about 2000 mg/mL of carrier. In the case of compositions containing supplementary active ingredients, the dosages are determined by reference to the usual dose and manner of administration of the said ingredients.

The cyclic molecular frameworks of the present invention may also have useful application as anti-pathogen agents in plants. Examples of pathogens include insects, spiders, viruses, fungi and other microorganisms causing deleterious effects. In particular, molecular frameworks may be engineered for use in conferring protection from pathogen (including insect) infestation of plants; for example, protection from insect attack in cotton. Such an activity may be engineered by the introduction of appropriate amino acid residues into the molecular framework, as described above, and their use in topical applications such as, e.g. in sprays.

Accordingly, the present invention provides a method for conferring pathogen protection to a plant, including the step of administering an engineered framework as hereinbefore described. Reference to administering includes reference to the topical application in liquid, aerosol, droplet, powdered or particulate form.

EXPERIMENTAL EXAMPLES

The following examples serve to illustrate certain preferred embodiments and aspects of the present invention and are not to be construed as limiting the scope thereof.

The abbreviations used are: kB1, kalata B1; RP-HPLC, reversed-phase high performance liquid chromatography; MALDI-TOF, matrix-assisted laser desorption ionization time-of-flight; CCK, cyclic cystine knot; SFTI-1, sunflower trypsin inhibitor-1; AEP, asparaginyl endopeptidase; SPE, solid phase extraction; CHCA, α-Cyano-4-hydroxycinnamic acid; CE, collision energy.

Example 1

Isolation and Characterization from C. ternatea Seeds

Seed Extraction.

Seed material (~0.20 g) from *C. ternatea* (Milgarra variety as supplied by Heritage Seeds, Rocklea, Australia) was ground in a mortar and pestle prior to solvent extraction with 100 mL of 50% (v/v) acetonitrile, 2% (v/v) formic acid. Crude extract was centrifuged for 4 min at 4,000×g, and the supernatant passed through a 0.45 micron syringe filter prior to lyophilization, yielding 430 mg material.

Solid Phase Extraction (SPE).

Crude plant extracts were redissolved in 1% (v/v) formic acid and underwent an SPE clean up step prior to further analysis. Waters C18 SPE cartridges of 100 mg to 10 g resin capacity were activated with 10 bed volumes of methanol and subsequently equilibrated with 10 bed volumes of 1% (v/v) formic acid. Following application of crude plant extracts, the cartridges were washed with a further 10 bed volumes of 1% (v/v) formic acid. Interfering substances were eluted from the cartridges in 10% (v/v) acetonitrile, and cyclotides collected in 20% to 80% (v/v) acetonitrile elution steps as separate fractions and lyophilized.

HPLC Purification.

Separation of cyclotides from crude *C. ternatea* extracts or SPE fractions was carried out using preparative or semi-preparative HPLC. For preparative HPLC, samples were reconstituted in 10% (v/v) acetonitrile, 1% (v/v) trifluoroacetic acid and introduced to a Phenomenex C18 RP-HPLC column (Torrance, Calif., USA) (250×21.2 mm, 15 µm, 300 Å). Using a Waters 600E HPLC unit (Milford, Mass., USA), a linear 1% min$^{-1}$ acetonitrile gradient was delivered to the column at a flow rate of 8 mL min$^{-1}$ and the eluent was monitored using a dual wavelength UV detector set to 214 and 280 nm, and fractions were collected. In semi-preparative HPLC separations, a Phenomenex C18 RP-HPLC column (250×10 mm, 10 µm, 300 Å) was utilized with a flow rate of 3 mL min$^{-1}$. Selected cyclotides were purified to >95% purity through repetitive RP-HPLC and duplicate samples submitted for amino acid analysis.

MALDI-TOF MS.

MALDI-TOF analyses were conducted using an Applied Biosystems 4700 TOF-TOF Proteomics Analyser (Foster City, Calif., USA). Samples were prepared through 1:1 dilution with matrix consisting of 5 mg mL$^{-1}$ CHCA in 50% (v/v) acetonitrile, 1% (v/v) formic acid prior to spotting on a stainless steel MALDI target. MALDI-TOF spectra were acquired in reflector positive operating mode with source voltage set at 20 kV and Gridl voltage at 12 kV, mass range 1000-5000 Da, focus mass 1500 Da, collecting 1500 shots using a random laser pattern and with a laser intensity of 3500. External calibration was performed by spotting CHCA matrix 1:1 with Applied Biosystems Sequazyme Peptide Mass Standards Kit calibration mixture diluted 1:400 as described previously (Saska, I., et al., (2008) *J. Chromatogr. B* 872, 107-114).

Enzymatic Digestion.

Prior to tandem MS analyses, cyclotides were cleaved to produce linearized fragments following reduction and alkylation to prevent re-oxidation. Lyophilized samples were reconstituted in 100 mM NH$_4$HCO$_3$ (pH 8) and a 10 µL portion was reduced by addition of 10 µL of 10 mM dithiothreitol and incubation at 60° C. for 30 min in a nitrogenous atmosphere. Incubation with a further 10 µL of 100 mM iodoacetamide followed for 30 min at RT. Samples were split into three ~7 µL fractions for digestion by endoproteinase Glu-C (Sigma P2922), TPCK-treated bovine trypsin (Sigma T1426) or a combination of both enzymes. In the case of the single-enzyme digests, a sample of ~7 µL received 5 µL of 40 ng µL$^{-1}$ enzyme and 5 µL of 100 mM NH$_4$HCO$_3$. For the double-enzyme digest, a sample of ~7 µL was mixed with 5 µL of 40 ng µL$^{-1}$ of each enzyme. All three digests were incubated at 37° C. for 3 h and then quenched with formic acid. All samples were retained at 4° C. until further analysis.

Nanospray on QSTAR Pulsar.

Reduced and enzymatically digested samples were processed using C18 ziptips (Millipore) to remove salts and elicit a solvent exchange from aqueous solution to 80% (v/v) acetonitrile, 1% (v/v) formic acid. Samples (3 µL) were introduced to nanospray tips (Proxeon ES380) and 900 V was applied to the tip to induce nanoelectrospray ionization on a QSTAR Pulsar I QqTOF mass spectrometer (Applied Biosystems). The collision energy (CE) was varied from 10 to 60 V. Both TOF and product ion mass spectra were acquired and manually assigned using Analyst QS 1.1 Software.

Cter cyclotide peptides from seeds are aligned in Table 1, below.

TABLE 1

| SEQ ID NO: | Peptide | Amino acid sequence[a] | Exp. m/z | Exp. mass (Da) | Theor. mass (Da) | Error Δ(ppm) | Subfamily |
|---|---|---|---|---|---|---|---|
| 13 | Cter A | GVIPCGESCVFIPC-ISTVIGCSCKNKVCYRN | 1090.07 | 3267.19 | 3267.49 | -91.8 | Bracelet |
| 8 | Cter B | G-VPCAESCVWIPCTVTALLGCSCKDKVCYLN | 1084.58 | 3250.75 | 3250.45 | 92.6 | Bracelet |
| 9 | Cter C | G-VPCAESCVWIPCTVTALLGCSCKDKVCYLD | 1084.93 | 3251.76 | 3251.43 | 99.2 | Bracelet |
| 11 | Cter D | G-IPCAESCVWIPCTVTALLGCSCKDKVCYLN | 1089.26 | 3264.76 | 3264.46 | 91.0 | Bracelet |
| 10 | Cter E | G-IPCAESCVWIPCTVTALLGCSCKDKVCYLD | 1089.61 | 3265.79 | 3265.45 | 105.2 | Bracelet |
| 19 | Cter F | G-IPCGESCVFIPC-ISSVVGCSCKSKVCYLD | 1536.48 | 3070.94 | 3071.34 | -132.7 | Bracelet |
| 15 | Cter G | G-LPCGESCVFIPC-ITTVVGCSCKNKVCYNN | 1043.15 | 3126.42 | 3126.36 | 19.0 | Bracelet |
| 16 | Cter H | G-LPCGESCVFIPC-ITTVVGCSCKNKVCYND | 1043.48 | 3127.43 | 3127.34 | 26.8 | Bracelet |
| 22 | Cter I | GTVPCGESCVFIPC-ITGIAGCSCKNKVCYIN | 1052.33 | 3153.96 | 3154.39 | -135.7 | Bracelet |

TABLE 1-continued

| SEQ ID NO: | Peptide | Amino acid sequence[a] | Exp. m/z | Exp. mass (Da) | Theor. mass (Da) | Error Δ(ppm) | Subfamily |
|---|---|---|---|---|---|---|---|
| 23 | Cter J | GTVPCGESCVFIPC-ITGIAGCSCKNKVCYID | 1052.67 | 3154.99 | 3155.58 | -122.2 | Bracelet |
| 17 | Cter K | H-EPCGESCVFIPC-ITTVVGCSCKNKVCY-N | 1037.14 | 3108.39 | 3108.31 | 24.4 | Bracelet |
| 18 | Cter L | H-EPCGESCVFIPC-ITTVVGCSCKNKVCY-D | 1037.47 | 3109.39 | 3109.30 | 31.3 | Bracelet |

[a]Ile and Leu were determined by amino acid analysis where sufficient material was available, or assigned based upon homology with published cyclotide sequences.

Example 2

Isolation, Characterization and Synthesis of Cyclotides from *C. ternatea* Leaves Leaf Extraction.

Leaf material (~3.5 g) from *C. ternatea* plants (grown in St Lucia, Brisbane, Australia) was ground in a mortar and pestle prior to solvent extraction with 20 mL of 50% (v/v) acetonitrile, 2% (v/v) formic acid. Crude extract was centrifuged for 4 min at 4,000×g, and the supernatant passed through a 0.45 micron syringe filter prior to lyophilization.

Mass Spectrometry.

As described for the seed extracts, above, the aqueous leaf extract of was treated by reduction to break disulfide bonds, alkylation to block reactive cysteine residues, and digestion with endoproteinase Glu-C to linearize any cyclic peptides present in the extract. MALDI-TOF analyses were conducted using an Applied Biosystems 4700 TOF-TOF Proteomics Analyser (Foster City, Calif., USA) and UltrafleXtreme TOF-TOF instrument (Bruker, Bremen, Germany) as previously described (Poth, A. G., et al., (2011) *ACS Chem Biol*.). Linearized cyclotide-containing crude leaf extract was analyzed on a QStar® Elite hybrid LC-MS/MS system (Applied Biosystems/MDS SCIEX, Foster City, USA) equipped with a nano-electrospray ionization source. The collection of MS/MS spectra were searched against a custom-built database of cyclotides using the ERA methodology (Colgrave, et al., (2010), *Biopolymers* 94:592-601) using ProteinPilot. All MS/MS data were manually verified.

LC-MS/MS analyses showed a dominant peak at 20.9 min of m/z 1147.53 corresponding to a mass of 3439.60 Da for a linearized alkylated peptide (mass of native peptide 3073.60 Da). Examination of the full product ion MS/MS spectrum (FIG. 2) revealed the sequence of the peptide to be TCTLGTCYVPDCSCSWPICMKNGLPTCGE (SEQ ID NO:143) where the methionine was oxidised. The sequence was database (BLAST) searched and deduced to be a novel cyclotide. We previously reported the identification of 12 cyclotides in seed extracts from *C. ternatea* (Poth, et al., 2011, supra), all of which belong to the Bracelet cyclotide sub-family. This is the first report of a cyclotide belonging to the Möbius sub-family from Fabaceous plants. Using similar methods an additional six peptide sequences (including Cter A previously identified in *C. ternatea* seeds) were deduced and their sequences are summarized along with the original 12 sequences in FIG. 9.

NMR Spectroscopy.

Spectra were recorded at 600 and 900 MHz (Bruker Avance NMR spectrometers) on a sample containing 1 mM Cter M in 10% $D_2O$/90% $H_2O$. The two-dimensional spectra including, TOCSY, COSY and NOESY, were recorded as previously described Rosengren, K. J., et al., (2003) *J. Biol. Chem.* 278, 8606-8616. Distance restraints were obtained from a NOESY spectrum recorded with a 200 ms mixing time at 290 K. A family of structures that are consistent with the experimental restraints was calculated using the programs CYANA (Guntert, P. (2004) *Methods Mol Biol* 278, 353-378) and CNS (Brunger, A. T. (2007) *Nat Protoc* 2, 2728-2733). A set of 50 structures was calculated and the 20 lowest energy structures selected for further analysis. Structures were analyzed using the programs PROCHECK_NMR (Laskowski, R. A., et al., (1996) *J. Biomol. NMR* 8, 477-486) and PROMOTIF (Hutchinson, E. G. & Thornton, J. M. (1996) *Protein Sci.* 5, 212-220. MolMol (Koradi, R., et al., (1996) *J. Mol. Graph.* 14, 29-32) and PyMol were used to display the structural ensembles and surfaces of the peptides, respectively.

Example 3

Gene Discovery and Verification

One of the difficulties encountered when de novo analysing peptide MS/MS spectra is the inability to distinguish the isobaric residues Ile and Leu. Amino acid analysis can yield the amino acid composition, but when both residues are present in a given sequence it is not possible to determine their location. With this constraint in mind and with the aim of exploring biosynthesis of cyclotides within the Fabaceae we proceeded with gene sequence determination.

Total RNA was extracted from 97 mg leaf tissue of *C. ternatea* using TRIzol® LS reagent (Invitrogen). RNA was DNAse-treated (Ambion), and complementary DNA was generated using random hexamers and Superscript III reverse transcriptase (Invitrogen). A degenerate primer (Ct-For1A, 5'-CCiACNTGYGGNGARACNTG-3' SEQ ID NO:144) and an oligo-dT primer (5'-GCCCGGG $T_{20}$-3' SEQ ID NO:145) were initially used to amplify products from cDNA. Resulting PCR products were cloned into pGEM-T Easy Vector System (Promega) and independently amplified clones were sequenced. Rapid amplification of cDNA ends (RACE) was performed using the FirstChoice® RLM-RACE kit (Applied Biosystems) according to manufacturer's instructions. First strand cDNA synthesis was performed on leaf-derived RNA. Sequence-specific primers (Cter M-RACE-Rev1,5'-GGAAACACCAACCAAAATG-GATGT-3' SEQ ID NO:146; Cter M-RACE-Rev2,5'-TCACTGTTTTTGCATTAGCTGCAA-3' SEQ ID NO:147) were used for first and second round PCR amplifications respectively. PCR products were cloned and sequenced. Primers (Cter M-SpecFor, 5'-TCCTTATTTTCATCAAC-TATGGCTTA-3' SEQ ID NO:148; Cter M-SpecRev, 5'-TCATACATGATCACTTTTAGTTGG-3' SEQ ID NO:149) were designed near the ends of the overlapping gene sequences, and used to amplify full-length transcript from leaf-derived cDNA. Total Total RNA was isolated from leaf, and used to generate cDNA. A degenerate primer was designed based upon the highly conserved PTCGETC motif (SEQ ID NO:13), and used in combination with oligo-dT to isolate partial transcripts from cDNA. Analysis of PCR products revealed a single 402 bp band. Following cloning, sequence analysis of independently amplified clones revealed that partial cyclotide sequence was embedded within a precursor protein with a strikingly different (atypical) gene architecture compared to all previously determined cyclotide gene sequences.

In all cyclotide genes elucidated to date, mature cyclotide domains are followed by a small C-terminal region (CTR) tail of 3-11 amino acids comprising a small amino acids (Gly or Ala), a strictly conserved Leu in the second position which has been postulated to play a critical role in docking to a specific binding pocket of asparaginyl endoprotease during peptide excision and ligation reactions (Koradi, R., et al., (1996) *J. Mol. Graph.* 14, 29-32). In the case of the *C. ternatea*-derived sequence, the sequence of the mature peptide is flanked on the C-terminus by a 74 amino acid tail, in which the Gly and the 'critical' Leu notably absent. BLAST searching of this C-terminal tail region revealed that it possessed high sequence homology to the C-terminal portion of albumin-1 proteins from a variety of Fabaceae species.

Following 5' RACE amplification and alignment to previous sequences, a 514 bp consensus sequence was obtained. To confirm that this sequence represented a single mRNA expressed in *C. ternatea* leaf, primers were designed within the 5' and 3' untranslated regions, and a single 418 bp PCR product was amplified. Sequence analysis revealed this product was as predicted, and encoding a predicted protein of 127 amino acids (FIG. 10). The full protein sequence of the novel Fabaceae cyclotide precursor was aligned to the homologous albumin proteins identified in the initial BLAST search FIG. 18).

Figure 19:
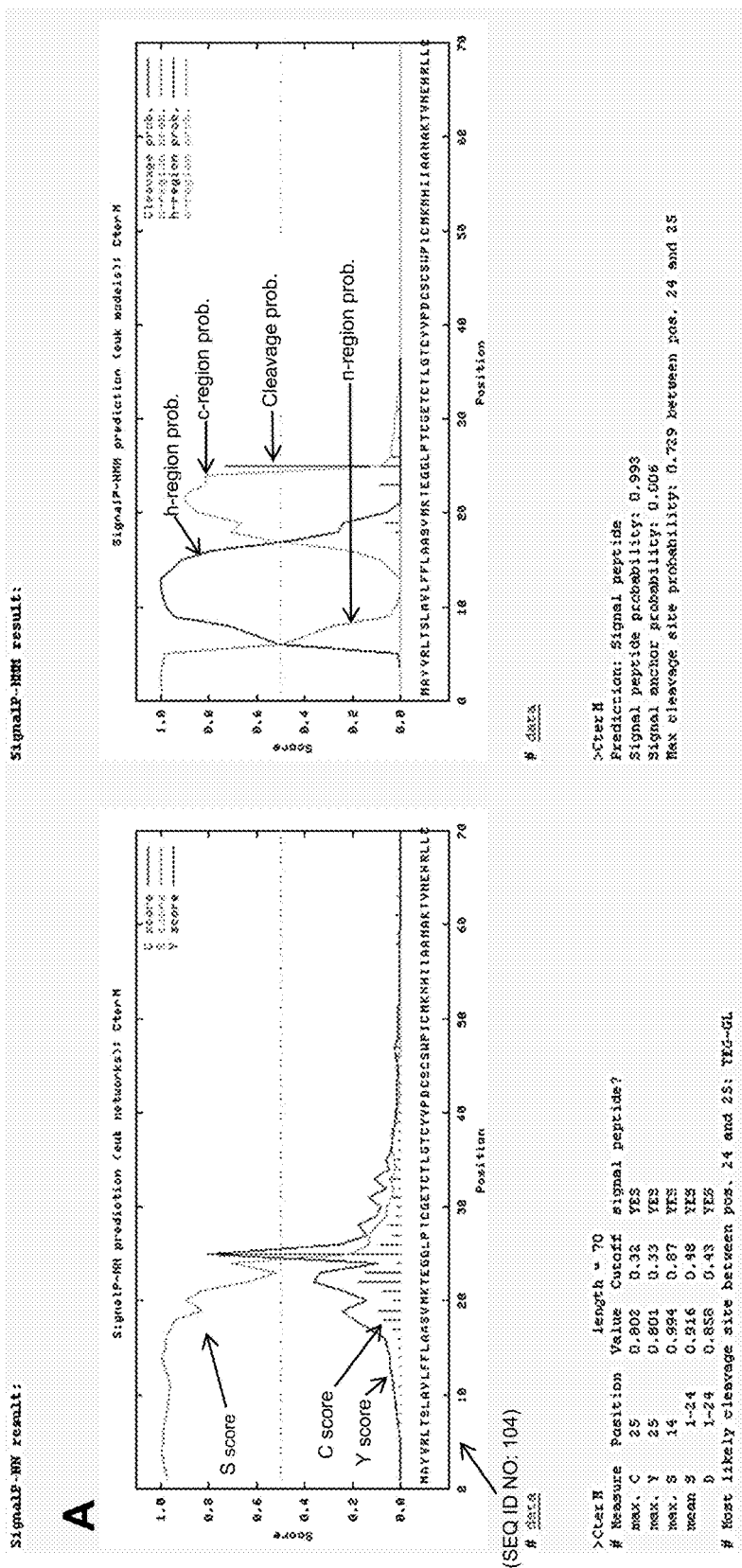
FIG. 19A-19F provides SignalP analysis of Cter M, kalata B1 and selected albumin-1 precursors from Fabaceae. Panel A-SignalP (Bendtsen, J. D., et al., (2004), *J. Mol. Biol.* 340, 783-795) analysis of Cter M precursor protein (partial sequence shown as SEQ ID NO:104) predicts signal peptidase cleavage at the proto-N-terminus of the mature cyclotide sequence, between signal peptide residues 24 and 25 (72.9% probability). Panel B—SignalP analysis of kalata B1 precursor protein (partial sequence shown as SEQ ID NO:105) predicts signal peptidase cleavage between precursor protein residues 22 and 23 (82.5% probability). As in all previously characterized cyclotide genes, a pro-region and an N-terminal repeat region are encoded prior to the start of the first cyclotide domain. Panels C through F—Respective SignalP analyses of albumin-1 precursor proteins from *Pisum sativum, Medicago truncatula, Phaseolus vulgaris*, and *Glycine max* (partial sequences shown as SEQ ID NOS:106-109, respectively) predict signal peptidase cleavage at the proto-N-termini of mature PA1b peptide sequences. Cleavages are predicted between residues 26 and 27 (53.0%), 22 and 23 (51.1%), 27 and 28 (69.7%), and 19 and 20 (98.6%) respectively.
Figure 19:
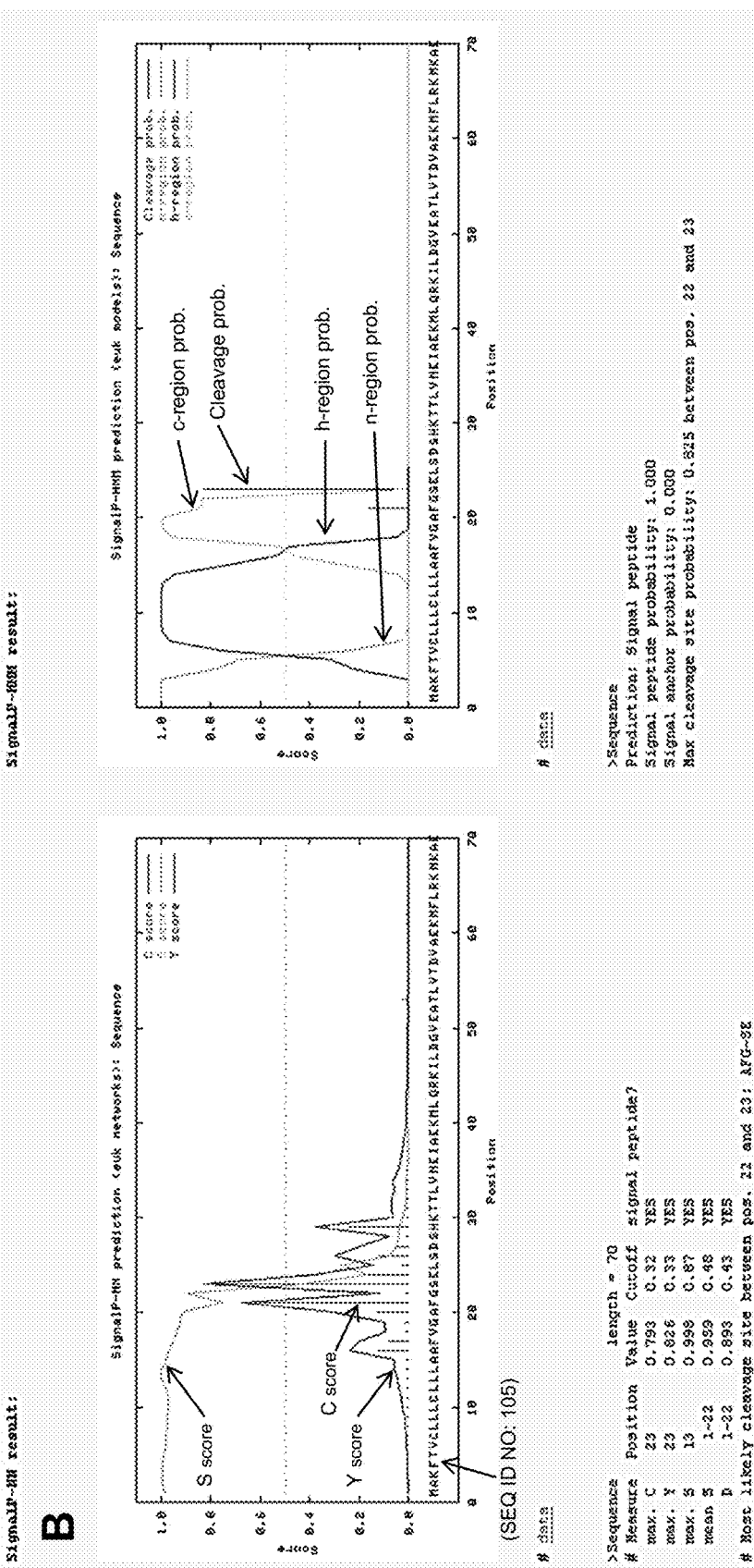
Figure 19:
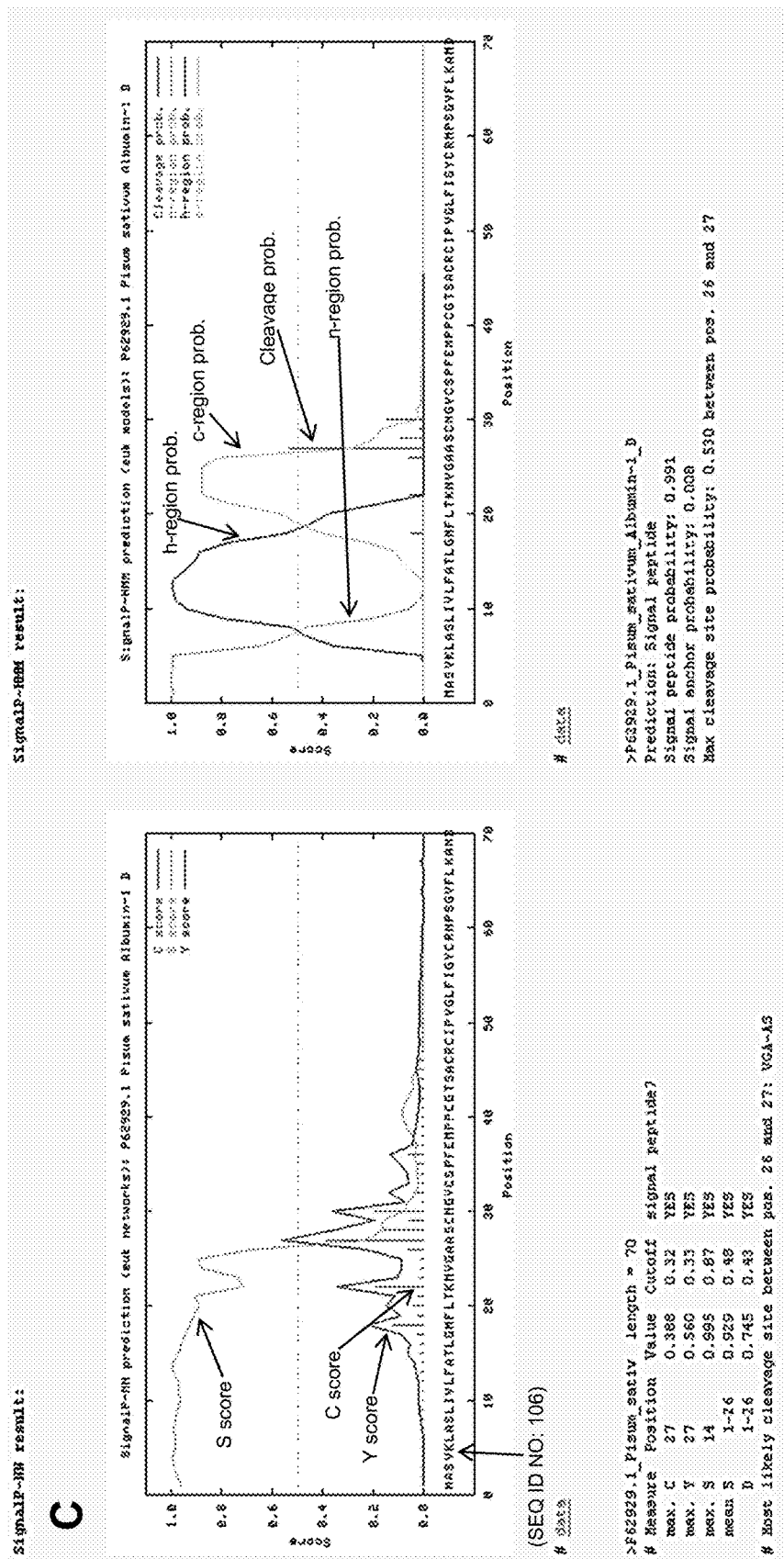
Figure 19:
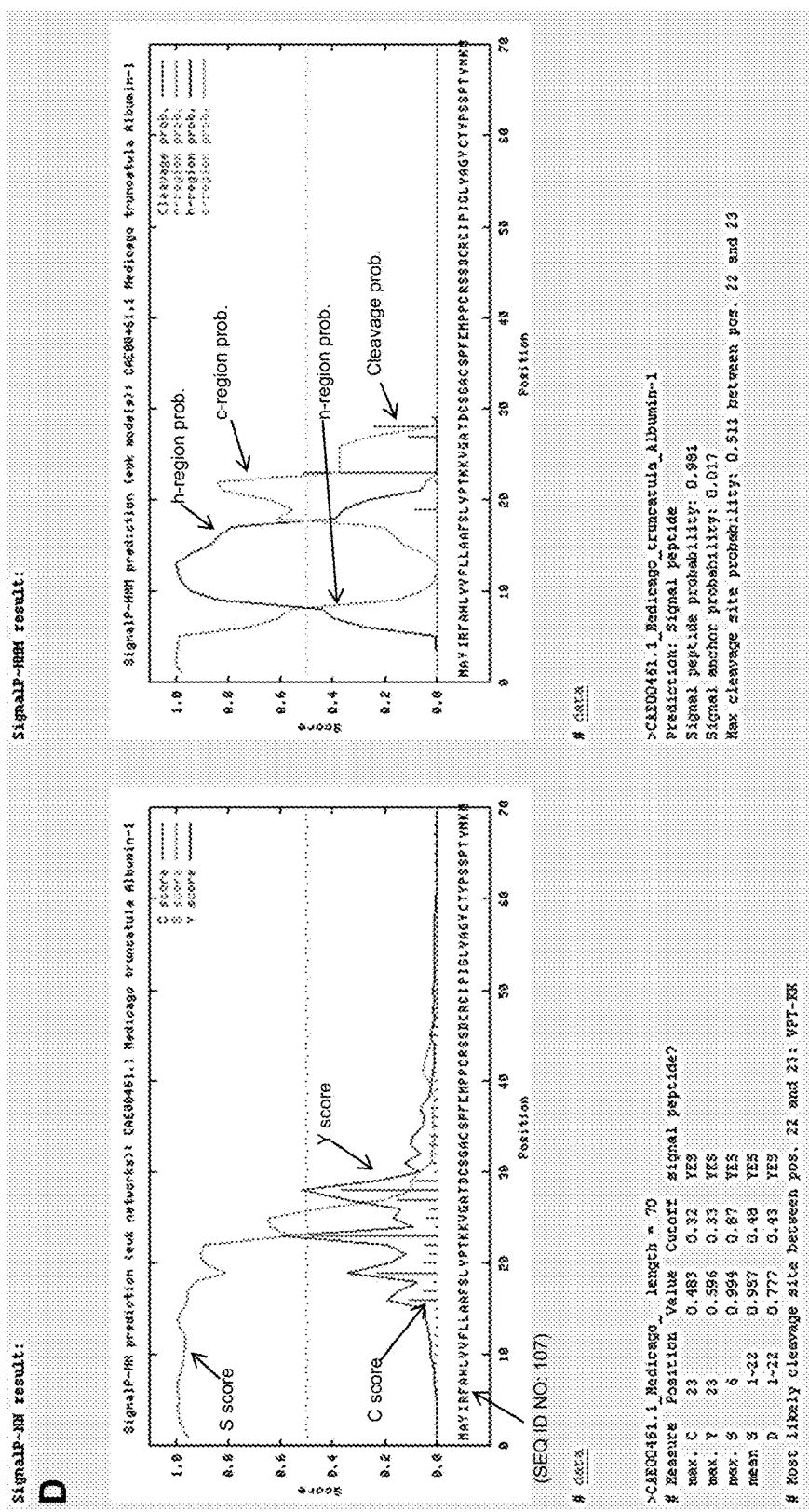
Figure 19:
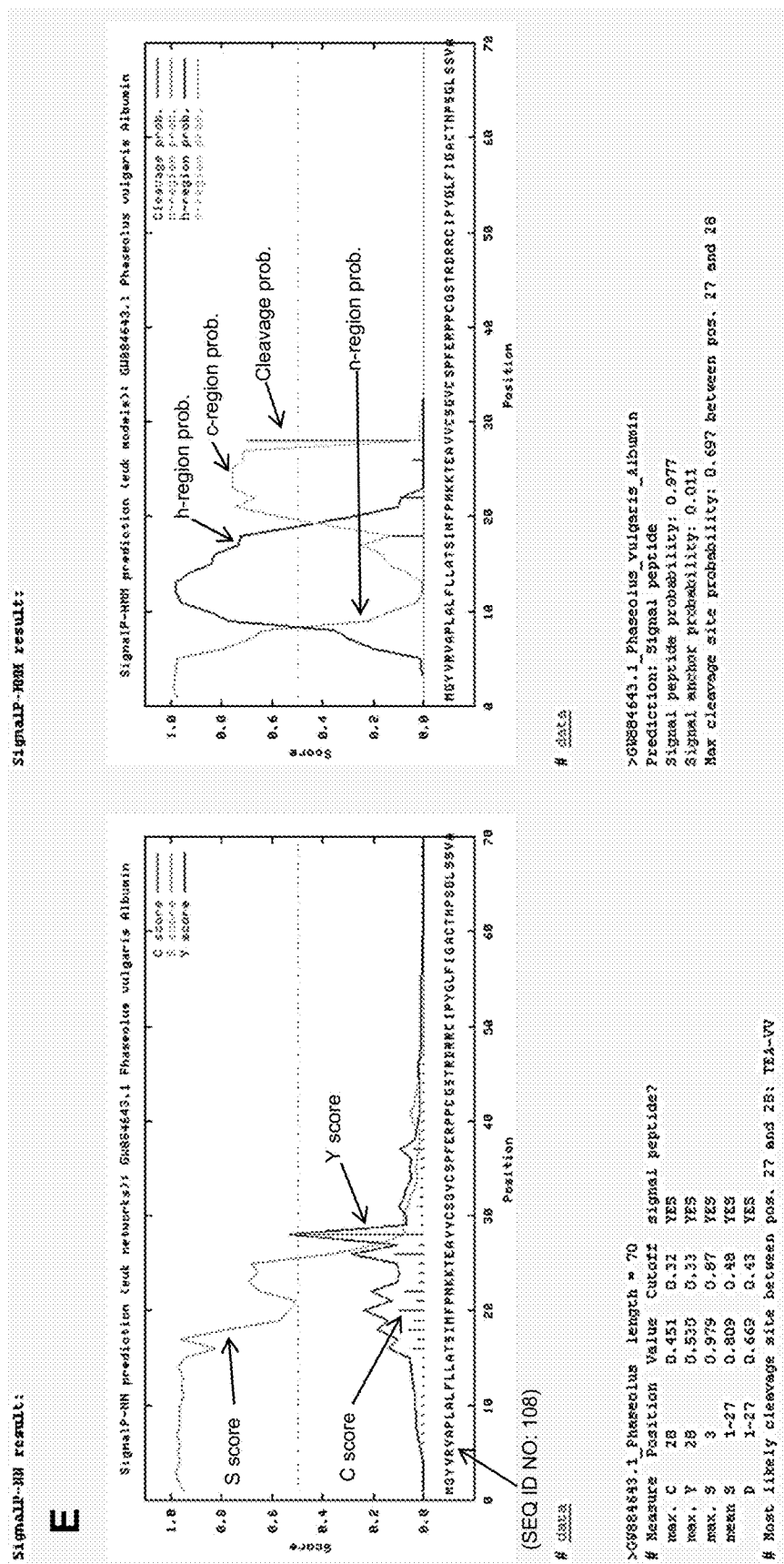
Figure 19:
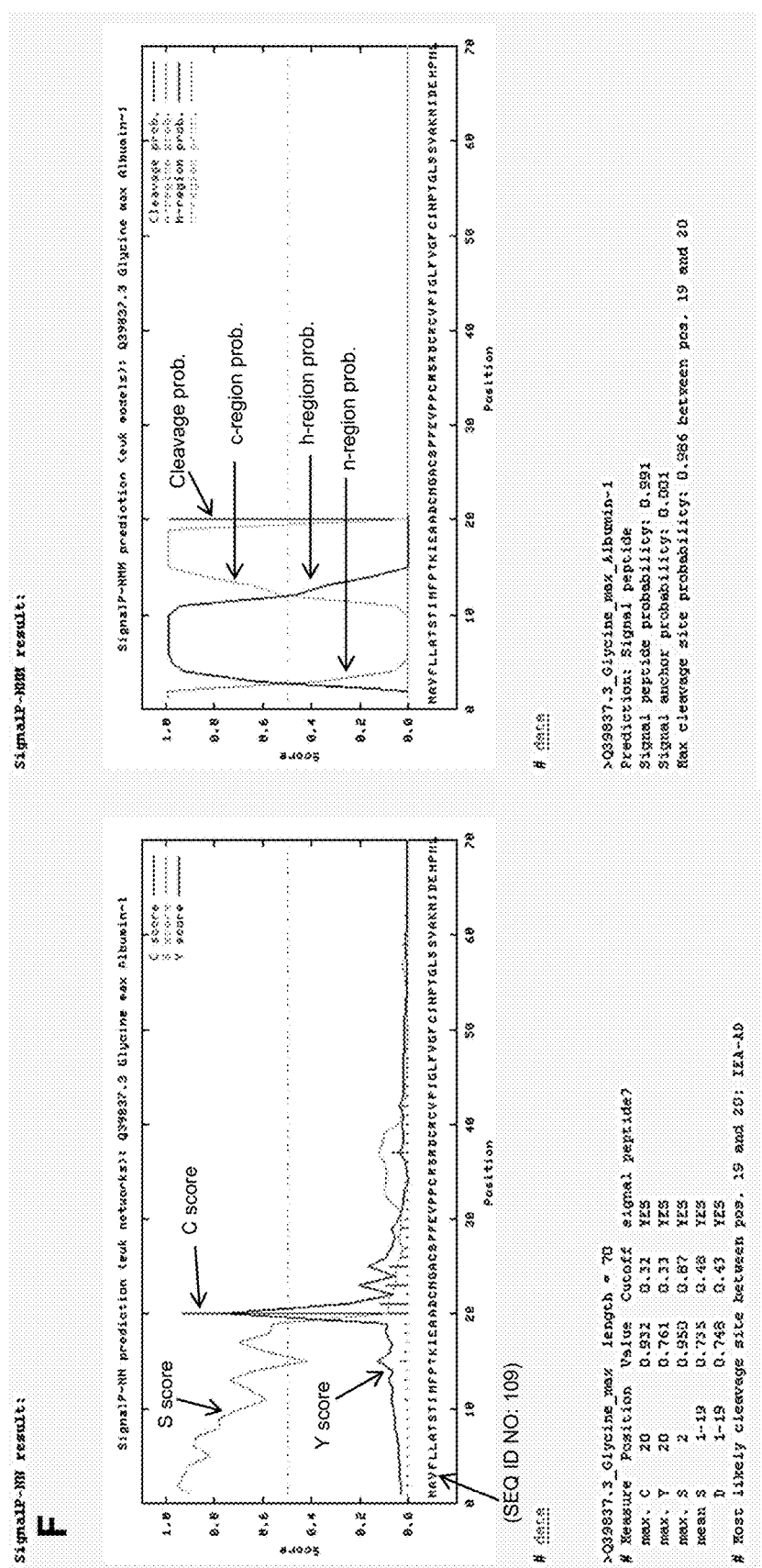
Figure 20:
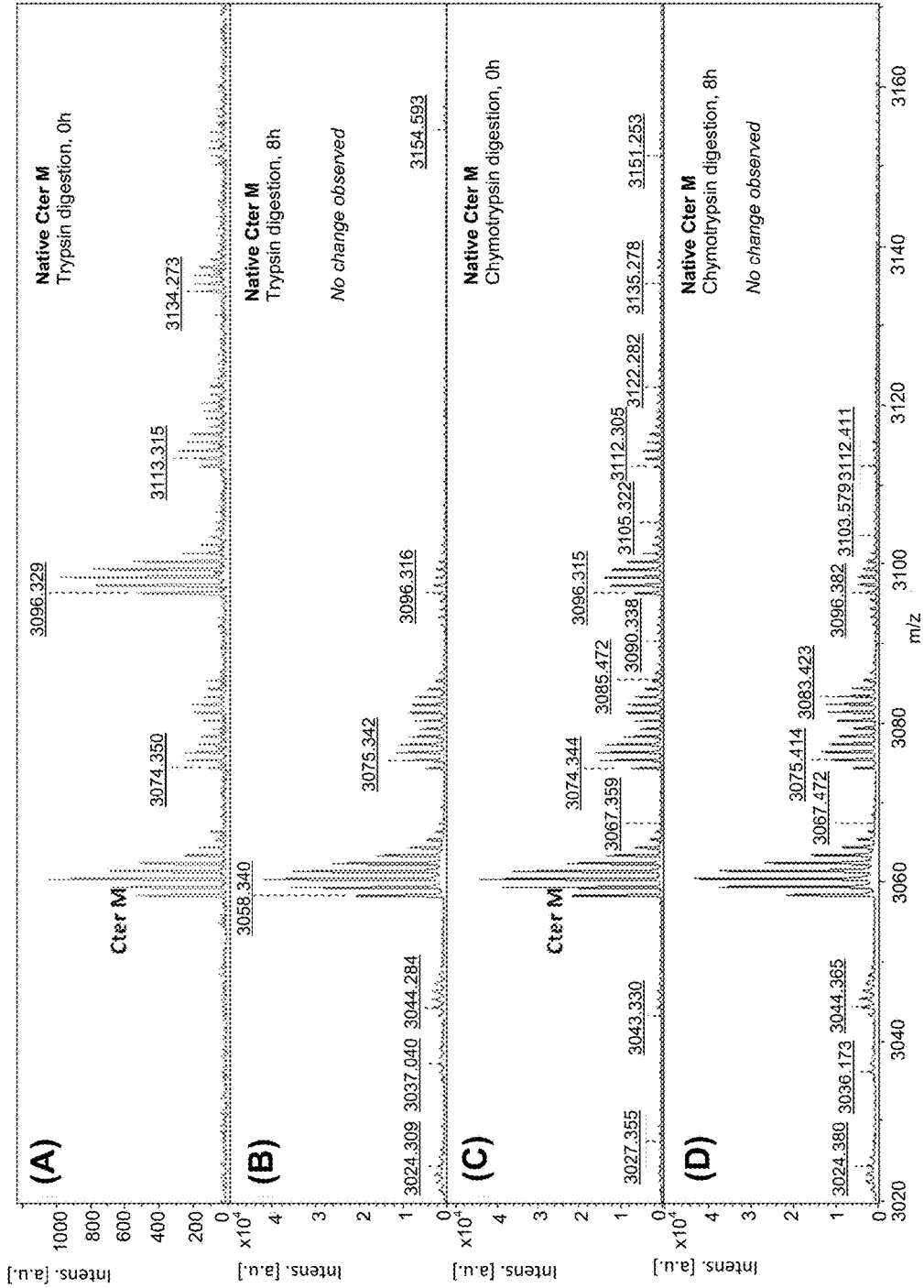
FIG. 20 shows that Cter M is resistant to proteolysis by trypsin and chymotrypsin. Leaf extract showing native Cter M at m/z 3058.3 (A, C) was subjected to trypsin (B) and chymotrypsin (D) digestion with no observed hydrolysis. The reduced and alkylated peptide, m/z 3407.6 (E, G, I) underwent proteolytic cleavage by trypsin (F) and chymotrypsin (H, J). As there is only a single tryptic site, the trypsin digestion product is observed at m/z 3424.6, whereas there were three chymotryptic sites resulting in the formation of major products at m/z 1450.7, 1511.7 and 1931.8 corresponding to KNGLPTCGETCL (SEQ ID NO:129), VPDCSCSWPICM (SEQ ID NO:130) and KNGLPTCGET-CLGTCY (SEQ ID NO:131) respectively.
Figure 20:
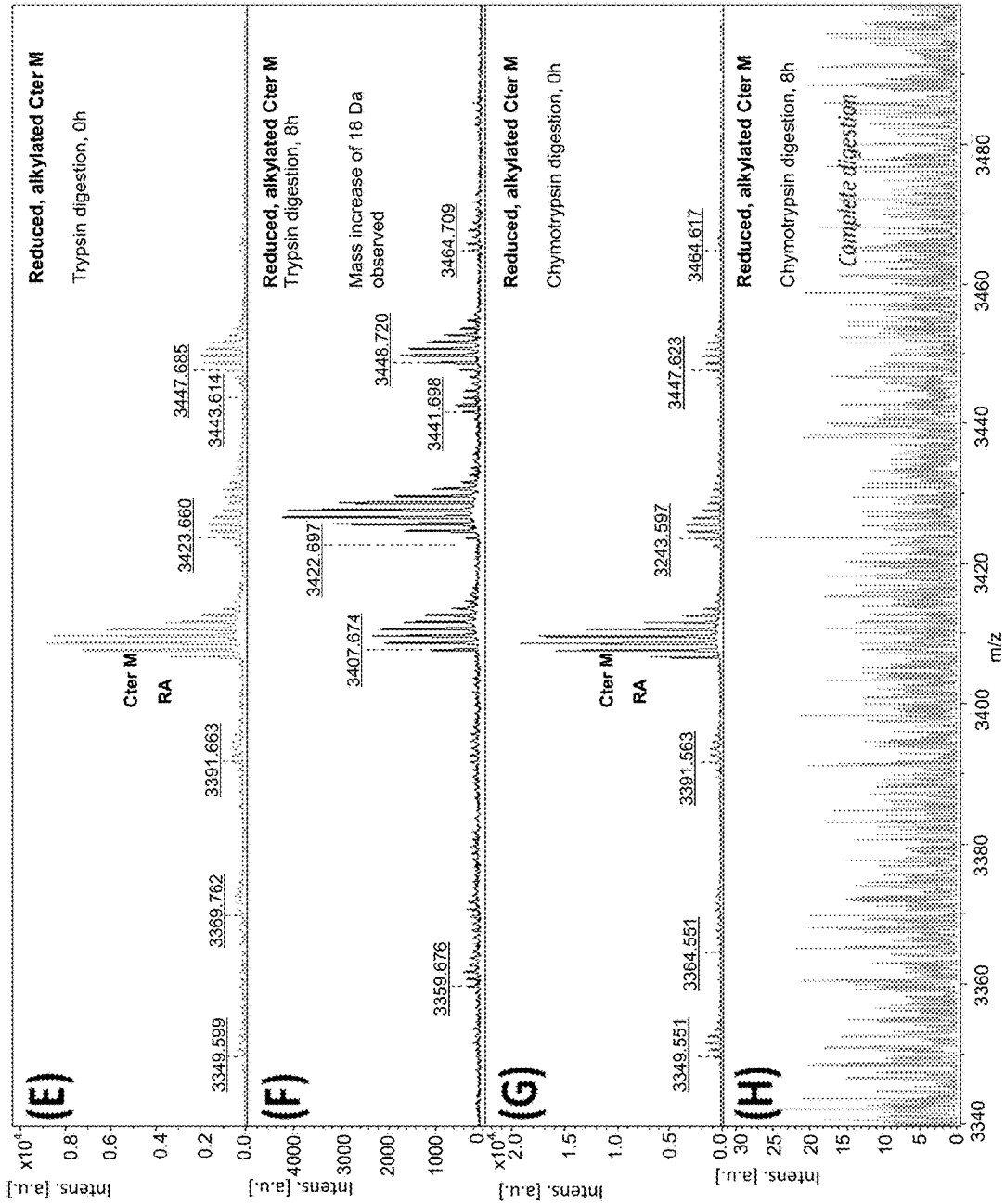
Figure 20:
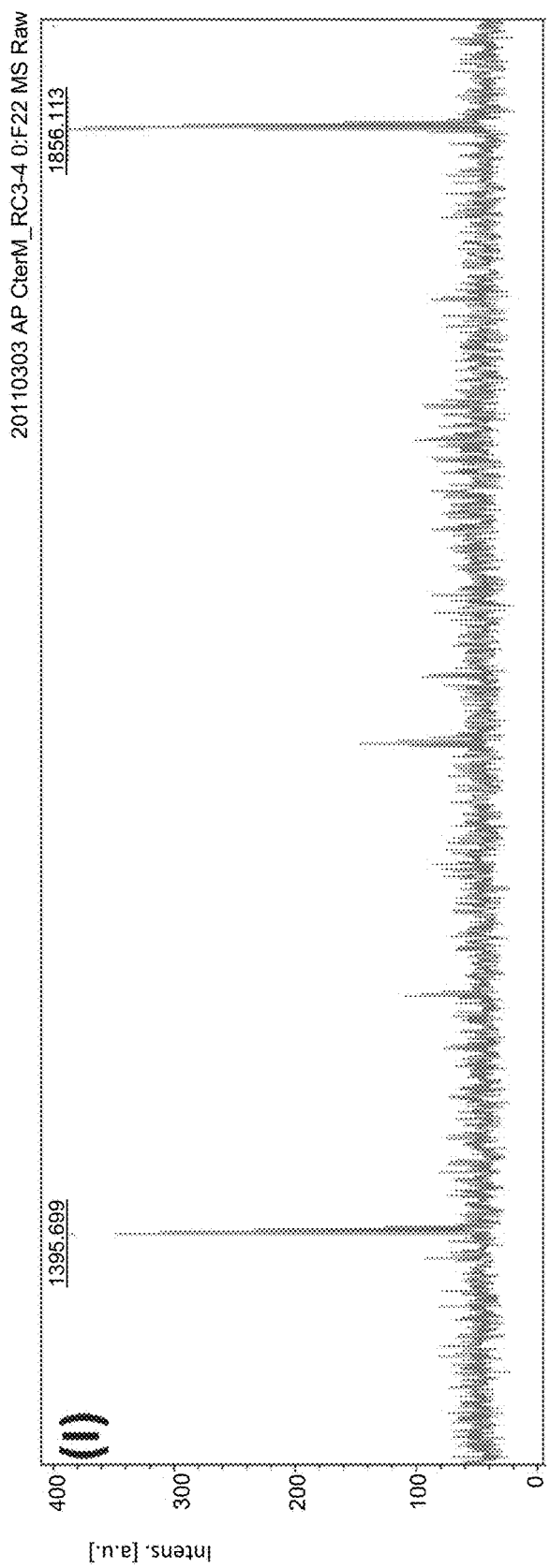
Figure 20:
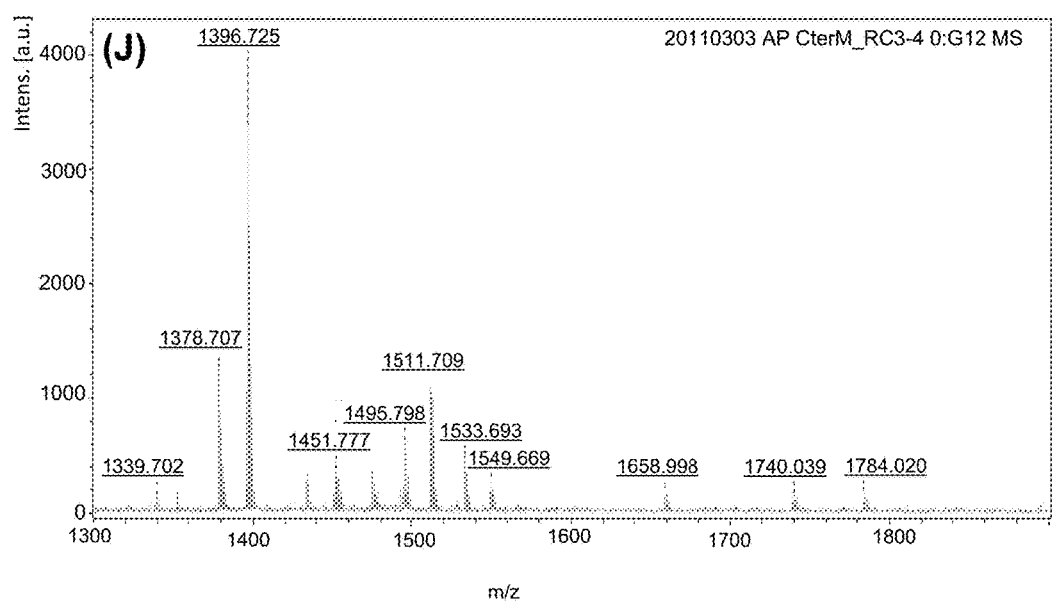

In the precursor protein encoding the prototypic cyclotide, kalata B1, the mature peptide sequence is flanked by 69 amino acids at the N-terminus and seven amino acids at the C-terminus, with each of the six cysteines in the precursor located within the mature kB1 sequence. In contrast, the Cter M precursor has a typical endoplasmic reticulum (ER) signal sequence of 24 amino acids, but the predicted signal peptide cleavage site immediately precedes the N-terminus of the mature cyclotide (FIGS. 11 and 19). In addition to the six cysteines present within the cyclotide domain, four cysteines are present within the albumin-like a-chain. Examples of nucleic acid encoding ER signal peptide and the corresponding peptides of Fabaceae include but are not limited to the following:

```
Fabaceae albumin-1 ER signal sequences:

Clitoria ternatea (JF501210):
Nucleotide sequence
ATGGCTTACGTTAGACTTACTTCTCTTGCCGTTCTCTTCTTCCTTGCTGCTTCCGTTAT
GAAGACAGAAGGA (SEQ ID NO: 127)
Amino acid sequence
MAYVRLTSLAVLFFLAASVMKTEG (SEQ ID NO: 128)

Phaseolus vulgaris (HM240265.1):
Nucleotide sequence
ATGGGTTATGTTAGGGTTGCTCCTTTGGCTCTCTTCTTGCTTGCCACTTCCATGATGTTTTC
GATGAAGAAGATAGAAGCT (SEQ ID NO: 150)
Amino acid sequence
MGYVRVAPLALFLLATSMMFSMKKIEA (SEQ ID NO: 151)

Phaseolus vulgaris (GW898230.1):
Nucleotide sequence
ATGGGTTATGTTAGGGTTGCTCCTTTGGCTCTCTTCTTGCTTGCCACTTCCATAATGTTTCC
GATGAAGAAGACAGAGGCA (SEQ ID NO: 152)
Amino acid sequence
MGYVRVAPLALFLLATSIMFPMKKTEA (SEQ ID NO: 153)

Pisum sativum (AJ276882.1):
Nucleotide sequence
ATGGCTTCCGTTAAACTCGCTTCTTTGATCGTCTTGTTTGCCACATTAGGTATGTTCCTGAC
AAAAAACGTAGGGGCA (SEQ ID NO: 154)
Amino acid sequence
MASVKLASLIVLFATLGMFLTKNVGA (SEQ ID NO: 155)

Medicago truncatula (BT053249.1):
Nucleotide sequence
ATGACTTATGTTAAGCTCATTACTTTGGCTCTATTCCTGGTTACCACACTCTTAATGTTTCA
GACAAAGAATGTTGAAGCA (SEQ ID NO:156)
Amino acid sequence
MTYVKLITLALFLVTTLLMFQTKNVEA (SEQ ID NO: 157)

Medicago truncatula (BG584516.1):
Nucleotide sequence
ATGGCTTATGTTAAGCTTGCTTCTTTTGCTGTCTTCTTGCTTGCTGCATTCGTAATGTTTCC
GATGAAAAAAGTAGAAGGA (SEQ ID NO: 158)
Amino acid sequence
MAYVKLASFAVFLLAAFVMFPMKKVEG (SEQ ID NO:159)

Glycine max (D17396.1):
Nucleotide sequence
ATGGCTGTCTTCTTGCTTGCCACTTCCACCATAATGTTCCCAACGAAGATAGAAGCA
(SEQ ID NO: 160)
```

Fabaceae albumin-1 ER signal sequences:

Amino acid sequence
MAVFLLATSTIMFPTKIEA (SEQ ID NO: 161)

Synthesis

Figure 22:
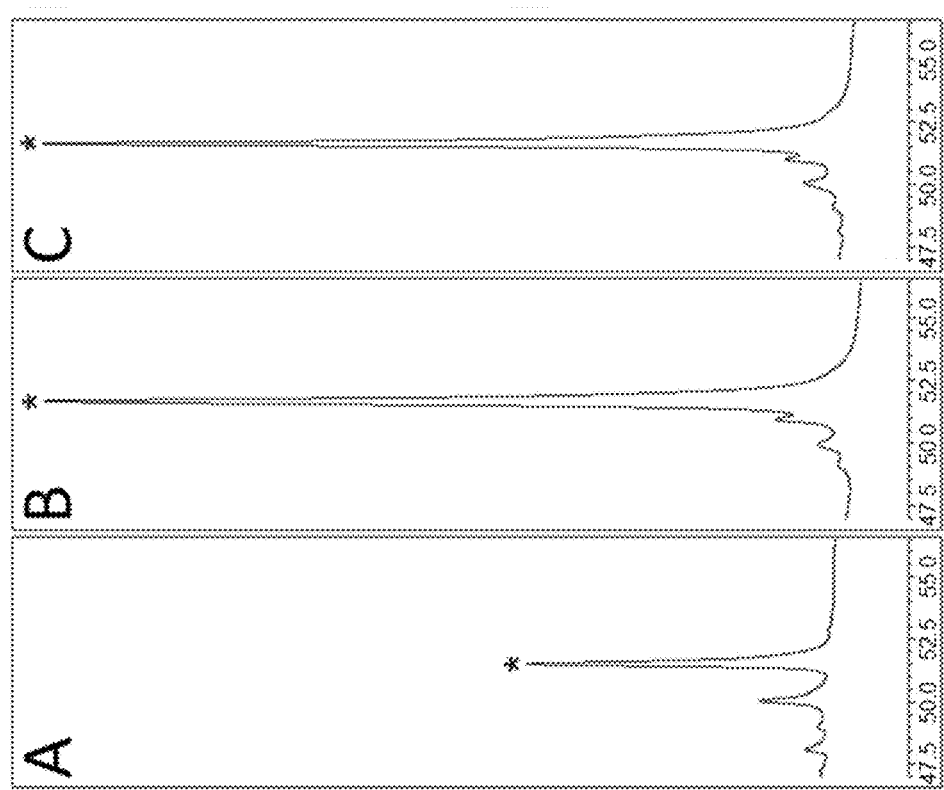
FIG. 22 shows analytical HPLC and mass spectrometric analysis showing that native and synthetic Cter M are identical. (A) Native Cter M; (B) Synthetic Cter M; and (C) Co-elution of Native and Synthetic Cter M. MALDI-TOF mass spectra of (D) Native Cter M extracted from *Clitoria ternatea* leaf material and (E) Synthetic Cter M.
Figure 22:
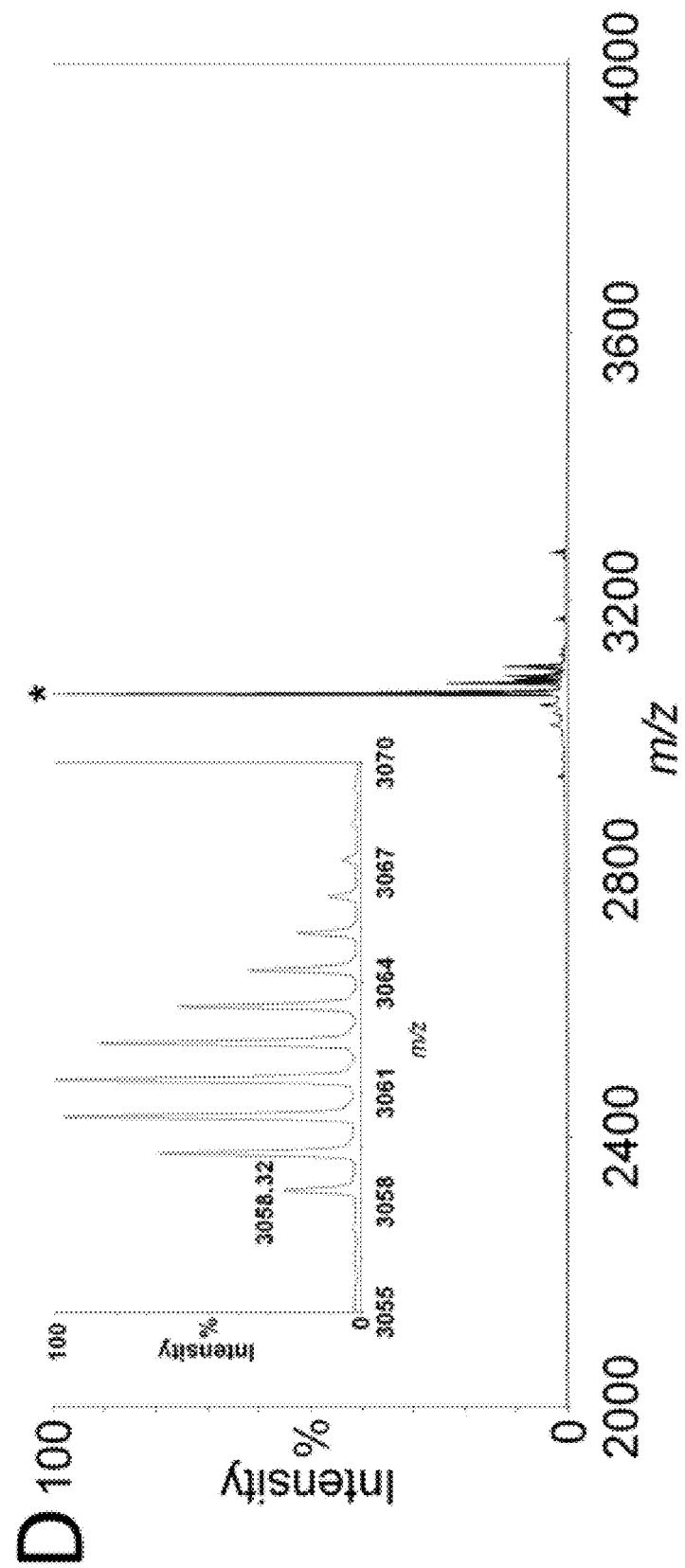
Figure 22:
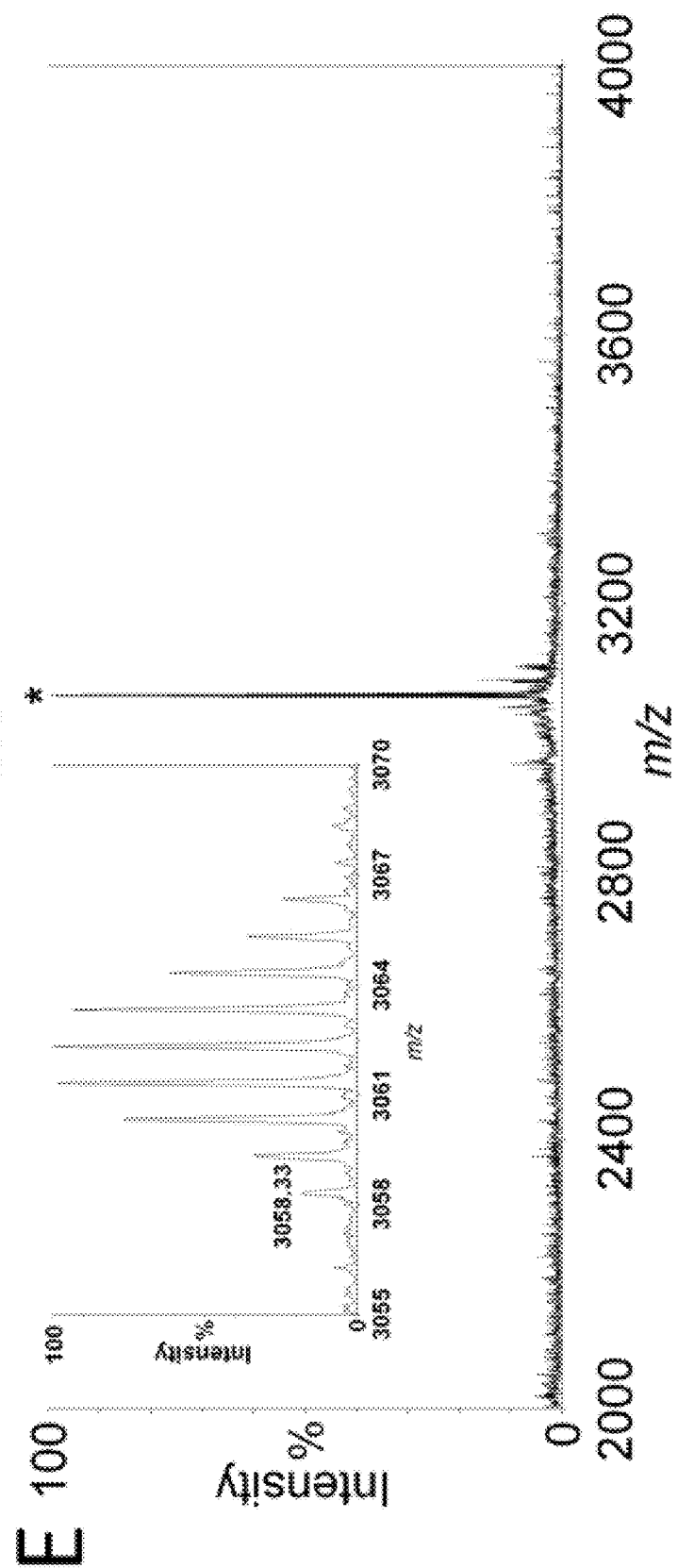

Cter M was synthesized using solid phase peptide synthesis and folded using conditions earlier established for other cyclotides (Daly, N. L., et al., (1999) *Biochemistry* 38, 10606-10614) including the use of 50% isopropanol in buffer. The synthetic peptide was identical to the native peptide by MS and HPLC (FIG. 22) and was noted to have relatively low solubility in water. The addition of acetonitrile greatly improved the solubility and the spectra of Cter M were thus recorded in the presence of acetonitrile. The NMR spectra of the native and synthetic Cter M peptides were recorded and found to be identical. The three-dimensional structure of Cter M was calculated with 398 distance restraints and 11 angle restraints using a simulated annealing protocol in CNS. The resulting family of structures had good structural and energetic statistics, as shown in Table 4, below.

TABLE 4

NMR and refinement statistics for Cter M.

| NMR distance & dihedral constraints Distance constraints | |
|---|---|
| Total NOE | 398 |
| Intra-residue | 84 |
| Sequential (\|i − j\| = 1) | 149 |
| Medium-range (\|i − j\| < 4) | 51 |
| Long-range (\|i − j\| > 5) | 114 |
| Total dihedral angle restraints | 11 |
| Structure Statistics Violations (mean and s.d.) | |
| Distance constraints (Å) | 0.02 ± 0.002 |
| Dihedral angle constraints (°) | 0.6 ± 0.13 |
| Max. dihedral angle violation (°) | 3 |
| Max. distance constraint violation (Å) | 0.3 |
| Deviations from idealized geometry | |
| Bond lengths (Å) | 0.003 ± 0.0002 |
| Bond angles (°) | 0.59 ± 0.03 |
| Impropers (°) | 0.49 ± 0.03 |
| Average pairwise r.m.s.d.** (Å) | |
| Backbone | 0.3 ± 0.08 |
| Heavy | 0.67 ± 0.18 |
| Ramachandran statistics | |
| % in most favoured region | 71.4 |
| % in additionally allowed region | 27.3 |
| % in generously allowed region | 1.4 |

**Pairwise r.m.s.d. was calculated among 20 refined structures.

Figure 14:
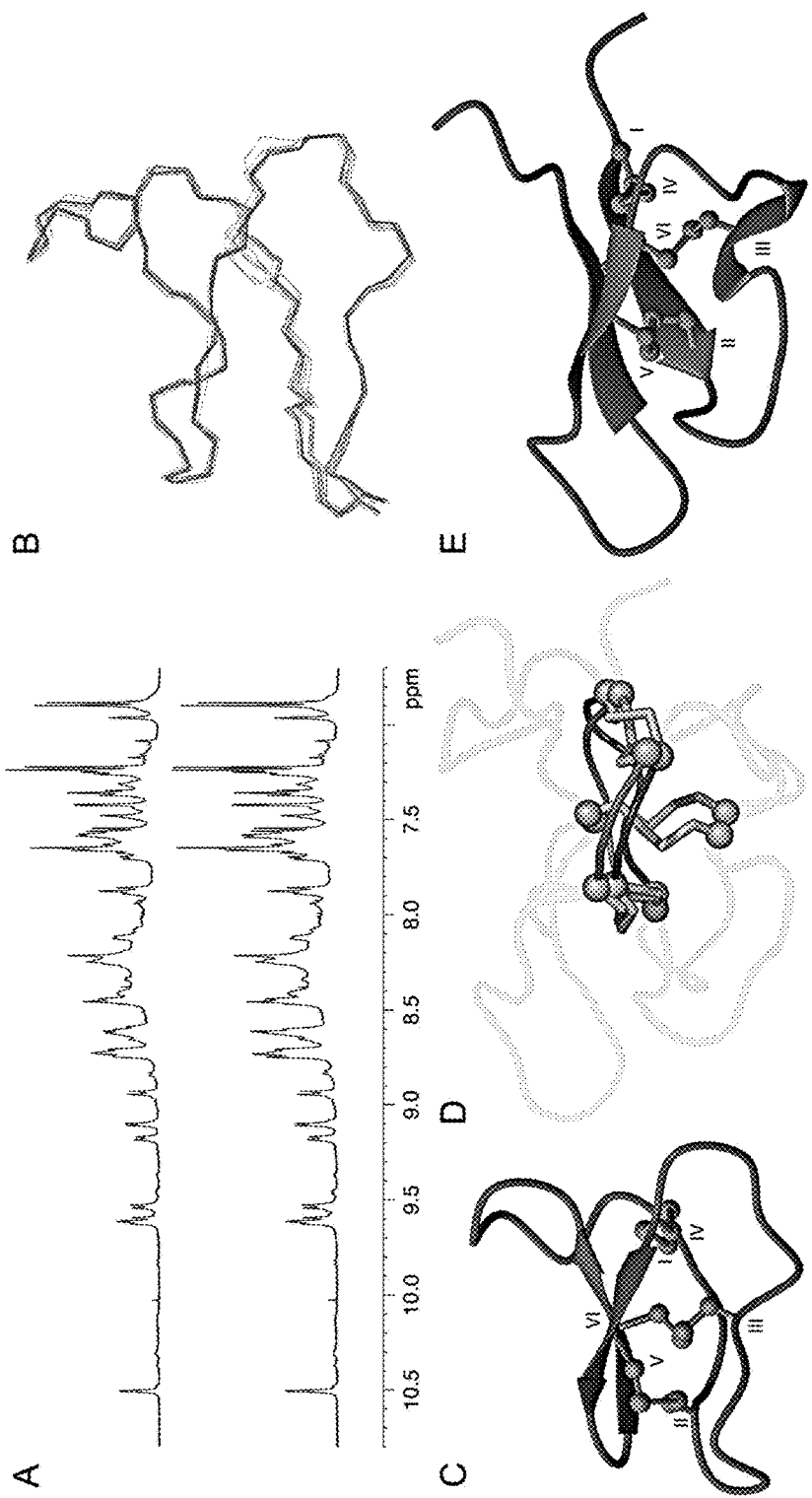
FIG. 14 shows the NMR spectra and three-dimensional structure of Cter M. (A) One-dimensional spectra of Cter M recorded before (top) and after (bottom) heating to 95° C. for 5 minutes. (B) Superposition of the 20 lowest energy structures of Cter M. Secondary structure of Cter M (C) and PA1b (E; PDB code 1P8B). The strands are shown as arrows and the helical turns as thickened ribbons. The disulfide bonds are shown in ball-and-stick format. The structure figures were generated using MOLMOL (Koradi, R., Billeter, M. & Wüthrich, K. (1996) *J. Mol. Graph.* 14, 29-32). Superimposition of Cter M and PA1b (D) showing cystine knot motif; disulfide bonds are indicated, and the aC are represented by spheres.

The structure of Cter M is extremely stable evidenced by its resistance to heat denaturation. Spectra were recorded before and after heating the peptide at 95° C. for 5 minutes and no changes were observed in the spectra as shown in FIG. 14a. An ensemble and ribbon representation of the three dimensional structure is shown in FIG. 14 along with a comparison with PA1b, the pea albumin whose precursor shares high sequence homology with the Cter gene. While variation in the loop regions of the two peptides is apparent, the eight-membered ring formed between loops 1 and 4 and the inter-connecting disulfide bonds (cysteine knot) shows striking similarities as evidenced by the superimposition in FIG. 14d.

Analysis of the structures of Cter M with PROMOTIF identified a type I β-turn between residues 9-12, a type II β-turn between residues 16-19 and a type VIaI β-turn between residues 22-25. A β-hairpin is recognized between residues 20-27, as shown in FIG. 14c. This β-hairpin is invariably present in inhibitor cystine knot proteins (Pallaghy, P. K., et al., (1994) *Protein Sci.* 3, 1833-1839; Craik, D. J., et al., (2001) *Toxicon* 39, 43-60).

Example 4

Haemolytic Activity Assays

Figure 15:
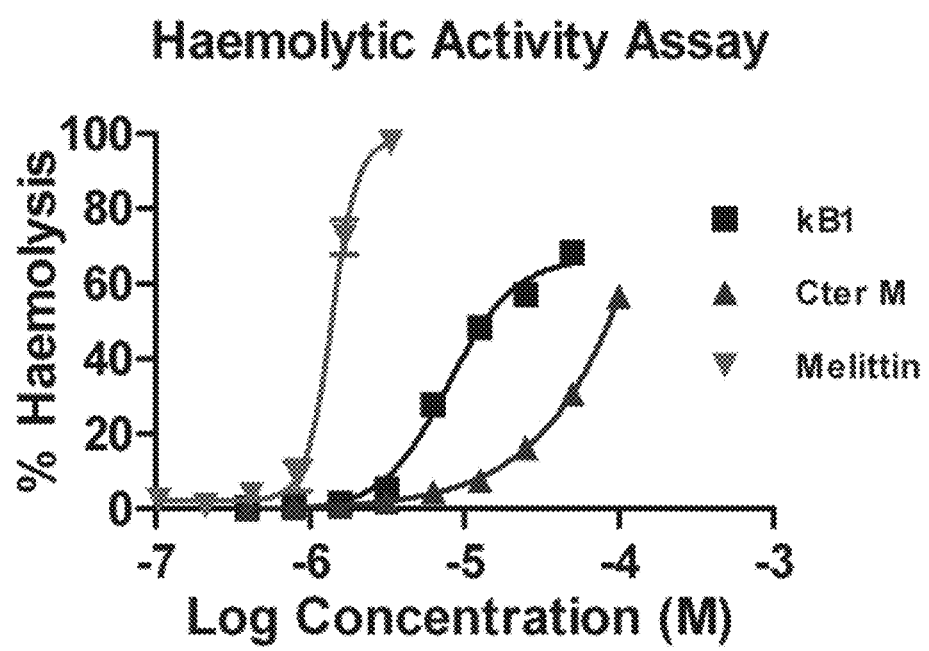
FIG. 15 provides a graph comparing haemolytic activity of Cter M with the prototypic cyclotide kalata B1 and the known pore-forming agent from bee venom, melittin.

Serially diluted peptide solutions were incubated with washed human red blood cells. Following incubation, the supernatant was transferred before the UV absorbance was measured. The amount of haemolysis was calculated as the percentage of maximum lysis (1% Triton X-100 control) after adjusting for minimum lysis (PBS control). Synthetic melittin was used for comparison. The haemolytic dose necessary to lyse 50% of the RBCs ($HD_{50}$) was calculated using the regression constant from the linear portion of the haemolytic titration curve (Graphpad Prism software). Results are presented in FIG. 15. The $HD_{50}$ was determined to be 1.4 µM for melittin, 7.8 µM for kB1 and >100 µM for Cter M, showing Cter M to be mildly haemolytic.

Example 5

Larval Migration Assays

Larval Migration Assays.

The effect of kB1 and Cter M on the motility of L3-stage larvae of *Haemonchus contortus* was assessed using a previously described method (Colgrave, et al., 2010, *Antimicrob. Agents Ch.* 54:2160-2166). The larvae were incubated in PBS containing a range of peptide concentrations for 24 h in the dark in a 96-well plate format. The motility of the worms was assessed wherein sinusoidal motion was indicative of health and loss of motility or the degree of motility was indicative of poor health. Nematodes that had been incubated with cyclotides were compared to control (no-peptide) wells.

Figure 16:
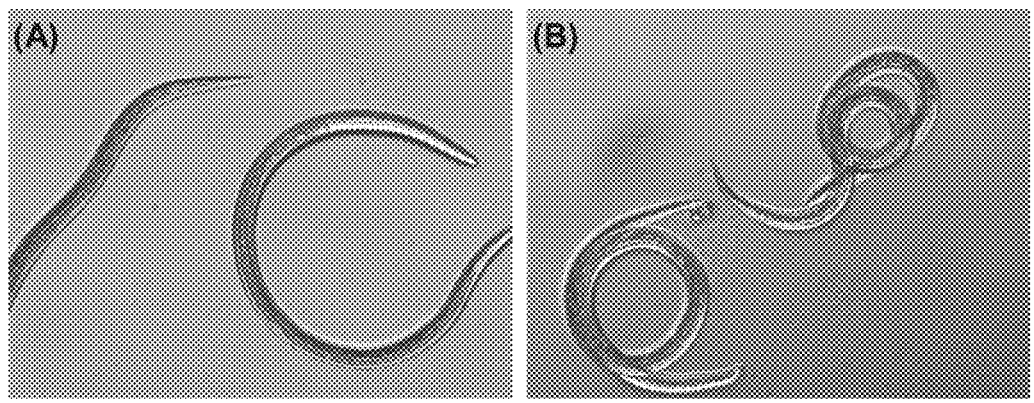
FIG. 16 illustrates the results following exposure of nematodes to control (no peptide) and Cter M cyclotide solutions. The effect of Cter M of the motility of L3 larvae of *Haemonchus contortus*: control worms (A) and cyclotide treated worms (B).
Figure 18A:
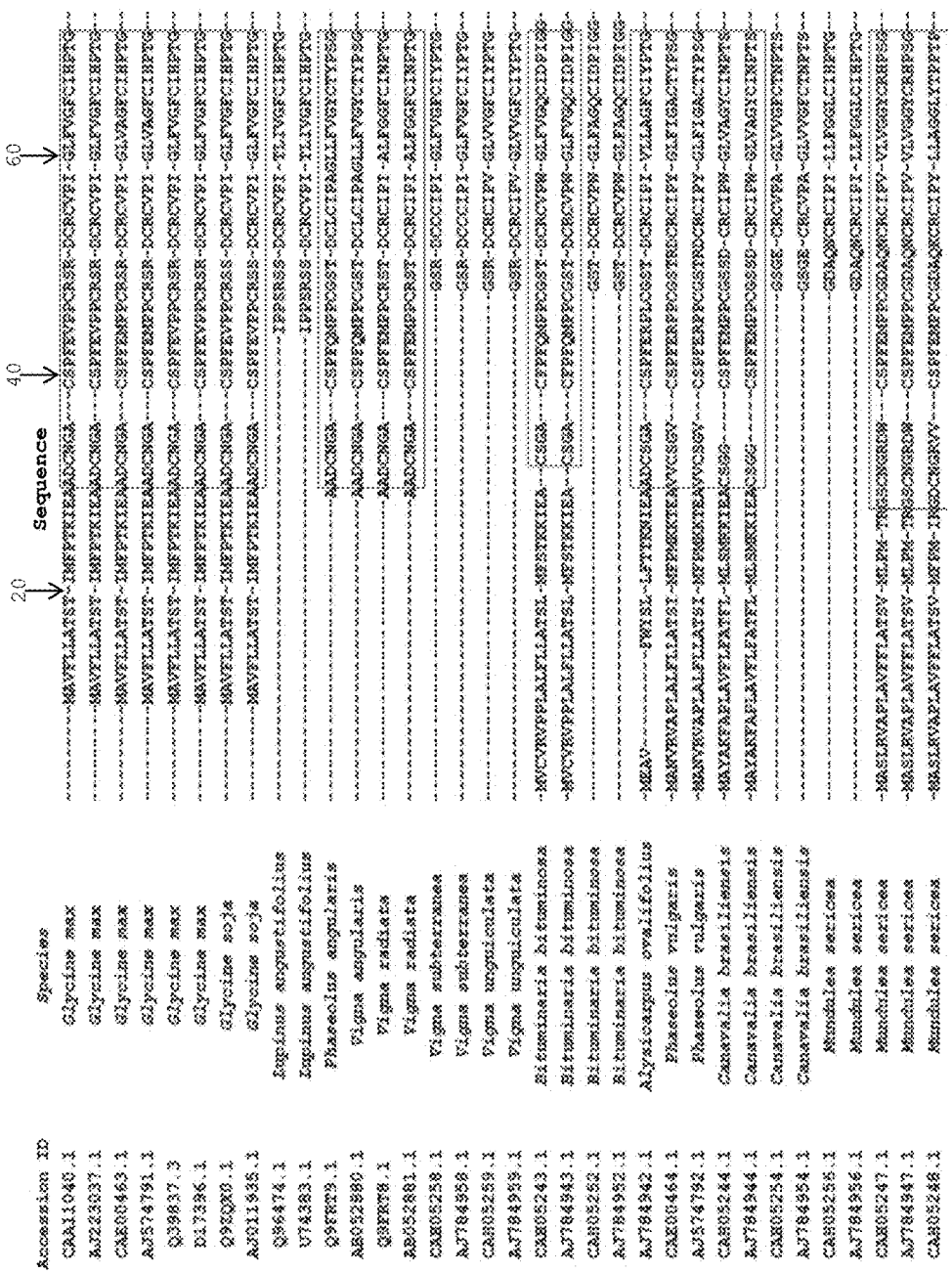
FIGS. 18A-B show a ClustalW2 alignment of Cter M with BLASTP- and TBLASTN-matched Fabaceae albumin-1 precursor proteins, in order from Accession ID No.CAA11040.1 to Accession No. CAH05248.1 (SEQ ID NO:37 through SEQ ID NO:70).
Figure 18B:
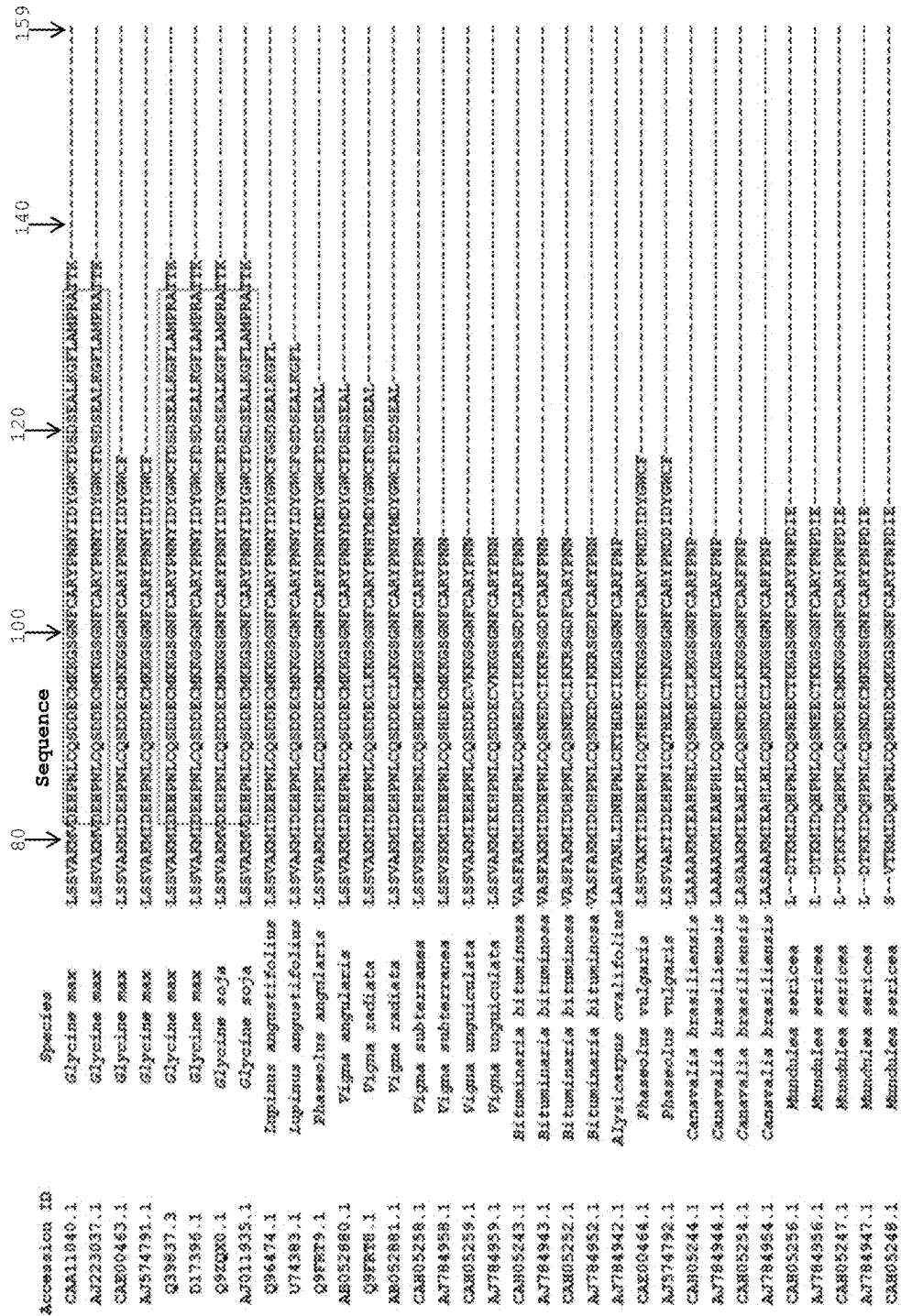
Figure 18C:
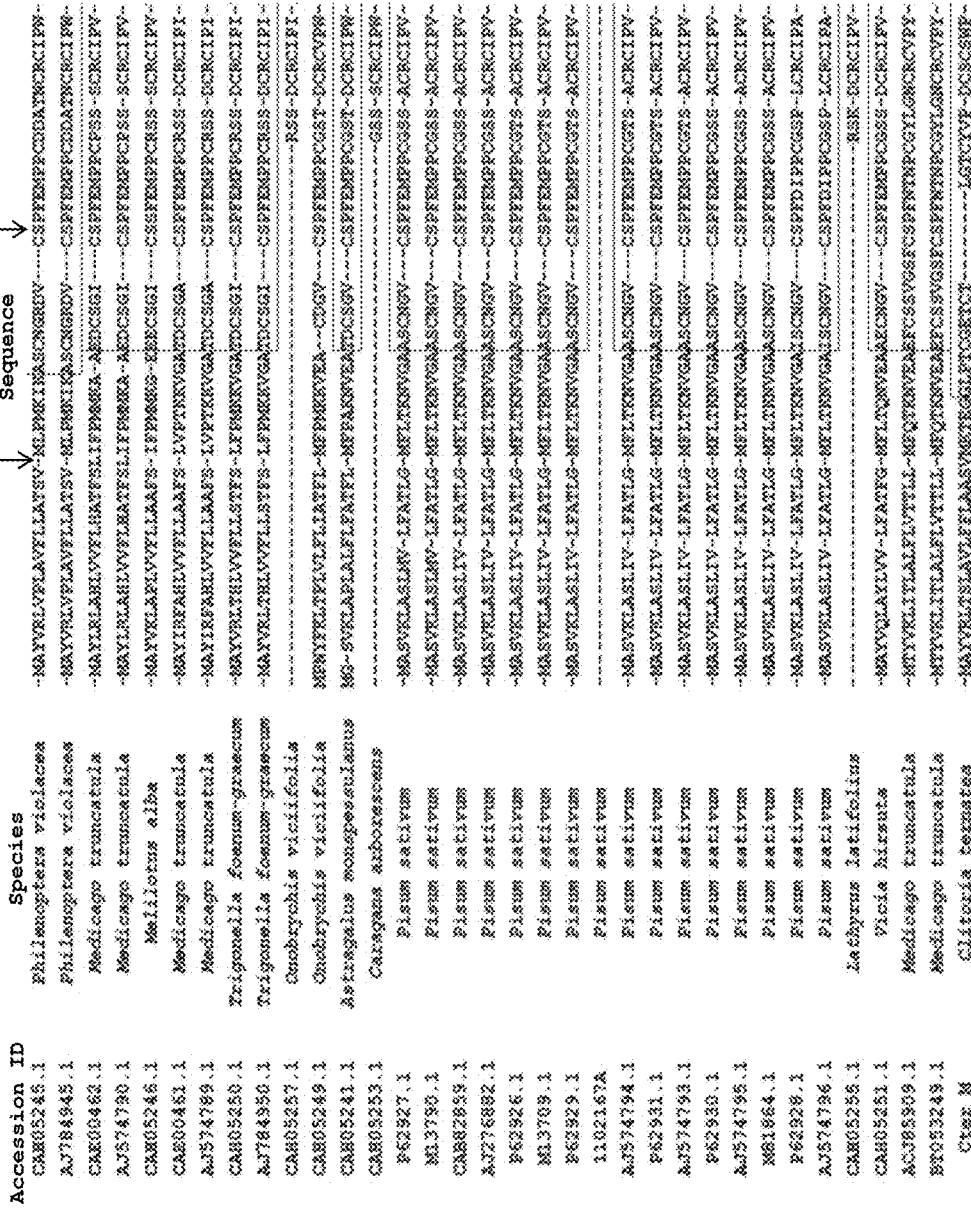
FIGS. 18C-D show a ClustalW2 alignment of Cter M with BLASTP- and TBLASTN-matched Fabaceae albumin-1 precursor proteins, in order from Accession ID No. CAH05245.1 to Accession ID No. BT053249.1 (SEQ ID NO:71 through SEQ ID NO:103), followed by Cter M (SEQ ID NO:28). N-terminal boxed regions outline mature PA1 chain-b peptide sequence in Fabaceae albumins, and the mature sequence of cyclotide Cter M. C-terminal boxed regions outline predicted mature PA1 chain-a peptide sequence.
Figure 18D:
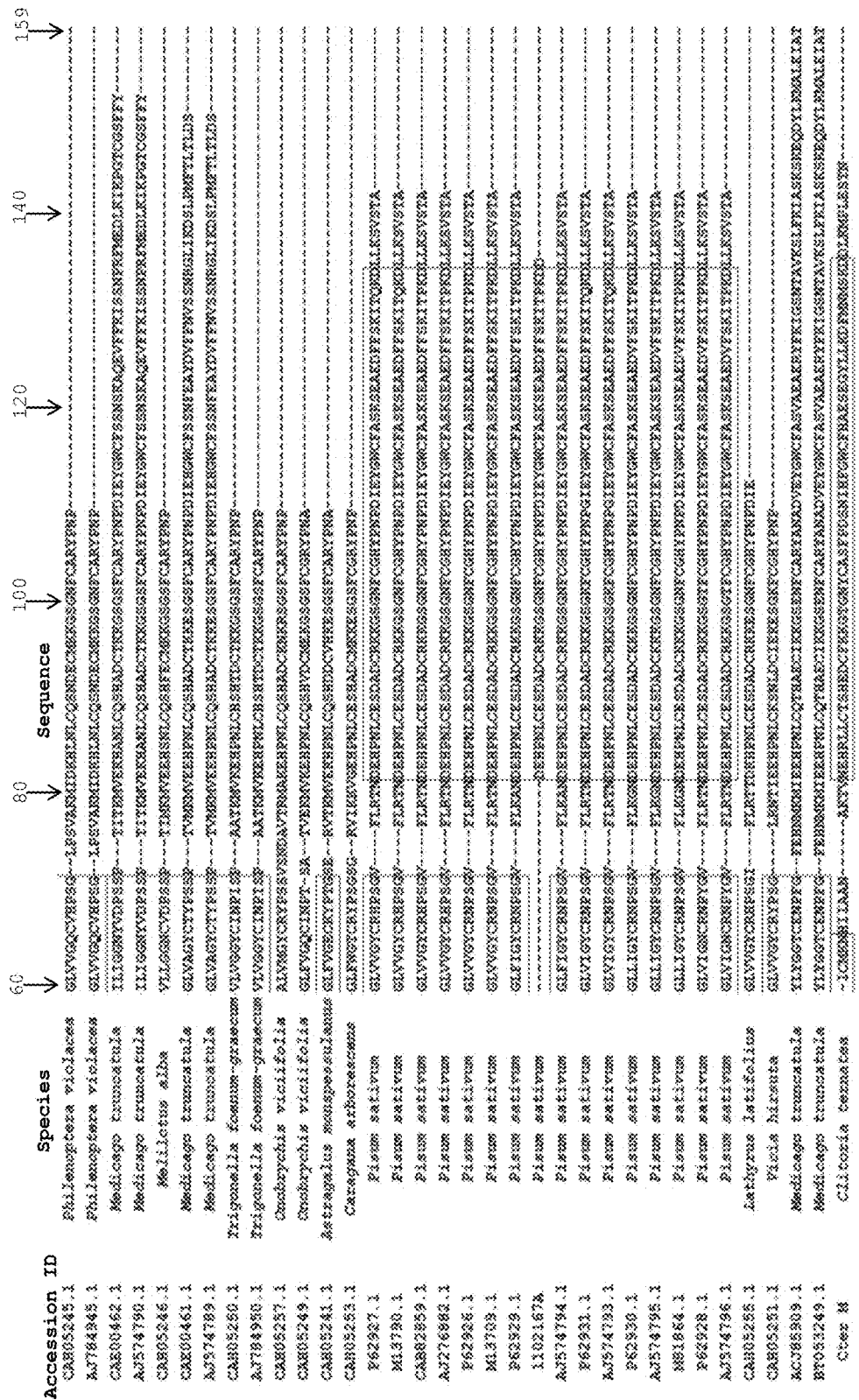

The results are shown in FIG. 16. Incubation with the cyclotides resulted in decreased motility of the nematodes as evidenced in the images. The control nematodes exhibited sinusoidal movement indicative of health (appeared extended in image on left, A), whereas the nematodes that had been treated with high concentrations of the peptides were coiled and showed very little movement or only a slight twitching (image on right, B).

Example 6

Insecticidal Assay

*H. armigera* larvae were obtained from the Queensland Department of Employment, Economic Development & Innovation. A feeding trial was conducted for 48 h with larvae maintained at 25° C. throughout the experiment. Larvae were given diets consisting of wheat germ, yeast, and soy flour. The test diets contained the peptide Cter M or kalata B1 (used as a positive control (Jennings, C., et al., (2001) *Proc Nat'l Acad Sci USA* 98, 10614-10619) and the control diet did not have any added peptide. Larvae were weighed at 0, 24 and 48 h. Following this, the larvae were photographed. Statistical differences were analyzed using a paired t-test or ANOVA test. Results are presented in FIG. 17.

Example 7

Expression of a Cyclotide-Encoding Gene in a Fabaceae Crop Plant

One aspect of this invention is the construction of transgenic plants to express either the entire cDNA encoding a cyclotide, such as Cter M (peptide sequence GLPTCGETCTLGTCYVPDCSCSWPICMKN (SEQ ID NO:25) and the PA1a albumin domain, or part thereof. Transgenic plant species may include many belonging to Fabaceae family, including soybeans (*Glycine max*), bean (*Phaseolus vulgaris*), pea (*Pisum sativum*), broadbean (*Vicia faba*), chickpea (*Cicer arietinum*), pigeonpea (*Cajanus cajan*), lupin (*Lupinus* spp), lentil (*Lens culinaris*) and cowpea (*Vigna unguiculata*). All of these species have been demonstrated to be amenable to genetic transformation and transgenesis (Eapen, (2008), *Biotechnol Adv,* 26, 162-168).

Expression cassettes are initially generated for transformation into soybean (*Glycine max*) using a modified pMON expression vector (Rogers, S. G., et al., (1987) *Methods Enzymol.* 153, 253-277). The coding sequence of the Cter M encoding gene with or without the PA1a albumin domain is fused with eGFP and cloned into the pMON530 binary vector under the control of the cauliflower mosaic virus 35S promoter or tissue specific promoters (see below). Transformation is performed as described above, and transformants are selected using 50 mg L21 kanamycin. The GFP fluorescence of transgenic plants is observed using a Zeiss confocal laser scanning microscope.

A range of promoters are utilised for assessment of CterM-GFP expression, including but not limited to CMV35S (Ealing, P. M., et al., (1994) *Transgenic Res.,* 3, 344-354), polyubiquitin promoter (Gmubi) from soybean (*Glycine max*) (Hernandez-Garcia, C. M., et al., (2009) *Plant Cell Rep.,* 28, 837-849), and monocot tissue-specific promoter from sorghum γ-kafirin seed storage protein gene (Defreitas, F. A., et al., (1994) *Mol. Gen. Genet.,* 245, 177-186). Expression cassettes are then introduced in the soybean plant genome using *Agrobacterium*-mediated transformation (Eapen, S. (2008) *Biotechnol Adv,* 26, 162-168) (Krishnamurthy, K. V., et al., (2000) *Plant Cell Rep.,* 19, 235-240); (Sharma, K. K., et al., (2006) *In Vitro Cell. Dev. Pl.,* 42, 165-173). Assessment of recombinant polypeptide in various tissues and sub-cellular compartments is via fluorescence studies and proteomic analysis of tissues for presence of cyclotides. These techniques have been used successfully for many transgenic plants including cowpea, chickpea, peanut and other members of the Fabaceae family (Collinge, D. B., et al., (2010) *Ann. Rev. Phytopathol.* 48, 269-291).

The nucleotide sequences of the embodiments can be used to isolate corresponding sequences from other organisms, particularly other plants. In this manner, methods such as PCR, hybridization, and the like can be used to identify such sequences based on their sequence homology to the sequences set forth herein. Sequences isolated based on their sequence homology to the nucleic acid sequence in FIG. 10, or to nucleic acids encoding the polypeptides of SEQ ID NOs 1-12 and 14-26 as set forth herein or to fragments thereof are encompassed by the embodiments.

All publications and patents mentioned in the above specification are herein incorporated by reference herein in their entireties, for all purposes. Various modifications and variations of the described methods and systems of the invention will be apparent to those skilled in the art without departing from the scope and spirit of the invention. Although the invention has been described in connection with specific preferred embodiments, it should be understood that the invention as claimed should not be unduly limited to such specific embodiments. Indeed, various modifications of the described modes for carrying out the invention that are obvious to those skilled in the relevant fields are intended to be within the scope of the following claims.

TABLE 2

| name | class | Loop 1 length | Loop 2 length | Loop 3 length | Loop 4 length | Loop 5 length | Loop 6 length | # 3D structures | Loop 1 | Loop 2 | Loop 3 | Loop 4 | Loop 5 | Loop 6 |
|---|---|---|---|---|---|---|---|---|---|---|---|---|---|---|
| TACA1_TACTR | Horseshoe_crab | 6 | 11 | 0 | 4 | 11 | — | 0 | QLQGFN | VVRSYGLPTIP | | RGLT | RSYFPGSTYGR | |
| TACA2_TACTR | Horseshoe_crab | 6 | 11 | 0 | 4 | 11 | — | 1 | QLQGFN | VVRSYGLPTIP | | RGLT | RSYFPGSTYGR | |
| TACB1_TACTR | Horseshoe_crab | 6 | 7 | 0 | 4 | 11 | — | 1 | LFRGAR | RVYSGRS | | FGYY | RRDFPGSIFGT | |
| TACB2_TACTR | Horseshoe_crab | 6 | 7 | 0 | 4 | 11 | — | 1 | LFRGAR | RVYSGRS | | FGYY | RRDFPGSIFGT | |
| A0ZSG4_FUGRU | agouti | 6 | 6 | 0 | 5 | 10 | — | 0 | LPLGGS | KSPGTE | | DFCAF | QCRLFRTVCY | |
| A0ZSG5_FUGRU | agouti | 6 | 5 | 0 | 5 | 10 | — | 0 | SQLTQS | VPQFG | | HPQAL | HCRFFNAICF | |
| A0ZSG6_FUGRU | agouti | 6 | 6 | 0 | 5 | 10 | — | 0 | IPHQQS | LGYPLP | | DPCDT | YCRFFNAICY | |
| A0ZSG7_FUGRU | agouti | 6 | 5 | 0 | 5 | 10 | — | 0 | SRLMES | SPYTP | | DPCAS | HCRLFNTICN | |
| A1YL76_9PRIM | agouti | 6 | 6 | 0 | 5 | 10 | — | 0 | VATRGS | KPPAPA | | HPCAS | QCRFFRSACS | |
| A2ALT3_MOUSE | agouti | 6 | 6 | 0 | 5 | 10 | — | 0 | VATRDS | KPPAPA | | DPCAS | QCRFFGSACT | |
| A4GVF2_CANLU | agouti | 6 | 6 | 0 | 5 | 10 | — | 0 | VATRNS | KSPAPA | | DPCAS | QCRFFRSACT | |
| A5JUA3_9GALL | agouti | 6 | 6 | 0 | 5 | 10 | — | 0 | VRLLES | LGHQIP | | DPCAT | YCRFFNAFCY | |
| A5JUA4_TRATE | agouti | 6 | 6 | 0 | 5 | 10 | — | 0 | VRLLES | LGHQIP | | DPCAT | YCRFFNAFCY | |
| A5JUA5_TRASA | agouti | 6 | 6 | 0 | 5 | 10 | — | 0 | VRLLES | LGHQIP | | DPCAT | YCRFFNAFCY | |
| A5JUA6_SYRRE | agouti | 6 | 6 | 0 | 5 | 10 | — | 0 | VRLLES | LGHQIP | | DPCAT | YCRFFNAFCY | |
| A5JUA7_ROLRO | agouti | 6 | 6 | 0 | 5 | 10 | — | 0 | VRLLES | LGHQIP | | DPCAT | YCRFFNAFCY | |
| A5JUA8_PERPE | agouti | 6 | 6 | 0 | 5 | 10 | — | 0 | VRLLES | LGHQIP | | DPCAT | YCRFFNAFCY | |
| A5JUA9_POLMA | agouti | 6 | 6 | 0 | 5 | 10 | — | 0 | VRLLES | LGHQIP | | DPCAT | YCRFFNAFCY | |
| A5JUB0_PAVMU | agouti | 6 | 6 | 0 | 5 | 10 | — | 0 | VRLLES | LGHQIP | | DPCAT | YCRFFNAFCY | |
| A5JUB1_9GALL | agouti | 6 | 6 | 0 | 5 | 10 | — | 0 | VRLLES | LGHQIP | | DPCAT | YCRFFNAFCY | |
| A5JUB2_POLEM | agouti | 6 | 6 | 0 | 5 | 10 | — | 0 | VRLLES | LGHQIP | | DPCAT | YCRFFNAFCY | |
| A5JUB3_PHACC | agouti | 6 | 6 | 0 | 5 | 10 | — | 0 | VRLLES | LGHQIP | | DPCAT | YCRFFNAFCY | |
| A5JUB4_PAVCR | agouti | 6 | 6 | 0 | 5 | 10 | — | 0 | VRLLES | LGHQIP | | DPCAT | YCRFFNAFCY | |
| A5JUB6_MELGA | agouti | 6 | 6 | 0 | 5 | 10 | — | 0 | VRLLES | LGHQIP | | DPCAT | YCRFFNAFCY | |

TABLE 2-continued

| name | class | Loop 1 length | Loop 2 length | Loop 3 length | Loop 4 length | Loop 5 length | Loop 6 length | # 3D structures | Loop 1 | Loop 2 | Loop 3 | Loop 4 | Loop 5 | Loop 6 |
|---|---|---|---|---|---|---|---|---|---|---|---|---|---|---|
| A5JUB7_9GALL | agouti | 6 | 6 | 0 | 5 | 10 | — | 0 | VRLLES | LGHQIP | | DPCAT | YCRFFNAFCY | |
| A5JUB9_LOPNY | agouti | 6 | 6 | 0 | 5 | 10 | — | 0 | VRLLES | LGHQIP | | DPCAT | YCRFFNAFCY | |
| A5JUC0_LAGLG | agouti | 6 | 6 | 0 | 5 | 10 | — | 0 | VRLLES | LGHQIP | | DPCAT | YCRFFNAFCY | |
| A5JUC1_LOPIM | agouti | 6 | 6 | 0 | 5 | 10 | — | 0 | VRLLES | LGHQIP | | DPCAT | YCRFFNAFCY | |
| A5JUC2_LOPED | agouti | 6 | 6 | 0 | 5 | 10 | — | 0 | VRLLES | LGHQIP | | DPCAT | YCRFFNAFCY | |
| A5JUC3_LOPDI | agouti | 6 | 6 | 0 | 5 | 10 | — | 0 | VRLLES | LGHQIP | | DPCAT | YCRFFNAFCY | |
| A5JUC4_GALSO | agouti | 6 | 6 | 0 | 5 | 10 | — | 0 | VRLLES | LGHQIP | | DPCAT | YCRFFNAFCY | |
| A5JUC5_FRAPO | agouti | 6 | 6 | 0 | 5 | 10 | — | 0 | VRLLES | LGHQIP | | DPCAT | YCRFFNAFCY | |
| A5JUC6_9GALL | agouti | 6 | 6 | 0 | 5 | 10 | — | 0 | VRLLES | LGHQIP | | DPCAT | YCRFFNAFCY | |
| A5JUC7_CATWA | agouti | 6 | 6 | 0 | 5 | 10 | — | 0 | VRLLES | LGHQIP | | DPCAT | YCRFFNAFCY | |
| A5JUC8_CROMA | agouti | 6 | 6 | 0 | 5 | 10 | — | 0 | VRLLES | LGHQIP | | DPCAT | YCRFFNAFCY | |
| A5JUC9_COTJA | agouti | 6 | 6 | 0 | 5 | 10 | — | 0 | VRLLES | LGHQIP | | DPCAT | YCRFFNAFCY | |
| A5JUD0_COTCO | agouti | 6 | 6 | 0 | 5 | 10 | — | 0 | VRLLES | LGHQIP | | DPCAT | YCRFFNAFCY | |
| A5JUD1_CROCS | agouti | 6 | 6 | 0 | 5 | 10 | — | 0 | VRLLES | LGHQIP | | DPCAT | YCRFFNAFCY | |
| A5JUD4_ALECH | agouti | 6 | 6 | 0 | 5 | 10 | — | 0 | VRLLES | LGHQIP | | DPCAT | YCRFFNAFCY | |
| A5JUD5_AFRCO | agouti | 6 | 6 | 0 | 5 | 10 | — | 0 | VRLLES | LGHQIP | | DPCAT | YCRFFNAFCY | |
| A5JUD6_ARGAR | agouti | 6 | 6 | 0 | 5 | 10 | — | 0 | VRLLES | LGHQIP | | DPCAT | YCRFFNAFCY | |
| A5JUD7_ALERU | agouti | 6 | 6 | 0 | 5 | 10 | — | 0 | VRLLES | LGHQIP | | DPCAT | YCRFFNAFCY | |
| A7YMS3_PERMA | agouti | 6 | 6 | 0 | 5 | 10 | — | 0 | VATRDS | KPPAPA | | DPCAS | QCRFFRSVCS | |
| A7YMS6_PERPL | agouti | 6 | 6 | 0 | 5 | 10 | — | 0 | VATRDS | KPPAPA | | DPCAS | QCRFFRSVCS | |
| A7YMS8_PERPL | agouti | 6 | 6 | 0 | 5 | 10 | — | 0 | VATRDS | KPPAPA | | DPCAS | QCRFFRSVCS | |
| A9EDH6_COTJA | agouti | 6 | 6 | 0 | 5 | 10 | — | 0 | VPNFKT | KPHLNS | | NYCAL | KCRIFQTICQ | |
| A9EDI0_COTJA | agouti | 6 | 6 | 0 | 5 | 10 | — | 0 | VPNFKT | KPHLNS | | NYCAL | KCRIFQTICQ | |
| A9JPS5_CAPHI | agouti | 6 | 6 | 0 | 5 | 10 | — | 0 | VATRDS | KPPAPA | | DPCAF | QCRFFRSACS | |
| AGRP_BOVIN | agouti | 6 | 6 | 0 | 5 | 10 | — | 0 | VRLHES | LGHQVP | | DPCAT | YCRFFNAFCY | |

TABLE 2-continued

| name | class | Loop 1 length | Loop 2 length | Loop 3 length | Loop 4 length | Loop 5 length | Loop 6 length | # 3D structures | Loop 1 | Loop 2 | Loop 3 | Loop 4 | Loop 5 | Loop 6 |
|---|---|---|---|---|---|---|---|---|---|---|---|---|---|---|
| AGRP_HUMAN | agouti | 6 | 6 | 0 | 5 | 10 | — | 2 | VRLHES | LGQQVP | | DPCAT | YCRFFNAFCY | |
| AGRP_MOUSE | agouti | 6 | 6 | 0 | 5 | 10 | — | 0 | VRLHES | LGQQVP | | DPCAT | YCRFFNAFCY | |
| AGRP_PIG | agouti | 6 | 6 | 0 | 5 | 10 | — | 0 | VRLHES | LGHQVP | | DPCAT | YCRFFNAFCY | |
| ASIP_BOVIN | agouti | 6 | 6 | 0 | 5 | 10 | — | 0 | VATRDS | KPPAPA | | DPCAF | QCRFFRSACS | |
| ASIP_CALGE | agouti | 6 | 6 | 0 | 5 | 10 | — | 0 | VSTRGS | KPPAPA | | HPCAS | QCRFFRSACS | |
| ASIP_CALGO | agouti | 6 | 6 | 0 | 5 | 10 | — | 0 | VSTRGS | KPPAPA | | HPCAS | QCRFFRSACS | |
| ASIP_CALJA | agouti | 6 | 6 | 0 | 5 | 10 | — | 0 | VATRNS | KSPAPA | | DPCAS | QCRFFRSACS | |
| ASIP_CANFA | agouti | 6 | 6 | 0 | 5 | 10 | — | 0 | VSTRGS | KPPAPA | | HPCAS | QCRFFRSACT | |
| ASIP_CEBPY | agouti | 6 | 6 | 0 | 5 | 10 | — | 0 | VATRDS | KPPAPA | | DPCAS | QCRFFRSACS | |
| ASIP_CERAE | agouti | 6 | 6 | 0 | 5 | 10 | — | 0 | VATRDS | KPPAPA | | DPCAS | QCRFFRSACS | |
| ASIP_CERMI | agouti | 6 | 6 | 0 | 5 | 10 | — | 0 | VATRNS | KPPAPA | | DPCAS | QCRFFRSACS | |
| ASIP_COLPO | agouti | 6 | 6 | 0 | 5 | 10 | — | 0 | VSTRGS | KPPAPA | | DPCAS | QCRFFRSACS | |
| ASIP_ERYPA | agouti | 6 | 6 | 0 | 5 | 10 | — | 0 | VSTRGS | KPPAPA | | DPCAS | QCRFFRSACS | |
| ASIP_FELCA | agouti | 6 | 6 | 0 | 5 | 10 | — | 0 | VATRDS | KPPAPA | | DPCAS | QCRFFRSACS | |
| ASIP_GORGO | agouti | 6 | 6 | 0 | 5 | 10 | — | 0 | VATRNS | KPPAPA | | DPCAS | QCRFFRSACS | |
| ASIP_HORSE | agouti | 6 | 6 | 0 | 5 | 10 | — | 2 | VATRNS | KPPAPA | | DPCAS | QCRFFRSACS | |
| ASIP_HUMAN | agouti | 6 | 6 | 0 | 5 | 10 | — | 0 | VSTRGS | KPPAPA | | HPCAS | QCRFFRSACS | |
| ASIP_LEOCY | agouti | 6 | 6 | 0 | 5 | 10 | — | 0 | VSTRGS | KPPAPA | | HPCAS | QCRFFRSACS | |
| ASIP_LEORO | agouti | 6 | 6 | 0 | 5 | 10 | — | 0 | VATRDS | KPPAPA | | DPCAS | QCRFFRSACS | |
| ASIP_MACAR | agouti | 6 | 6 | 0 | 5 | 10 | — | 0 | VATRDS | KPPAPA | | DPCAS | QCRFFRSACS | |
| ASIP_MACAS | agouti | 6 | 6 | 0 | 5 | 10 | — | 0 | VATRDS | KPPAPA | | DPCAS | QCRFFRSACS | |
| ASIP_MACCY | agouti | 6 | 6 | 0 | 5 | 10 | — | 0 | VATRDS | KPPAPA | | DPCAS | QCRFFRSACS | |
| ASIP_MACFA | agouti | 6 | 6 | 0 | 5 | 10 | — | 0 | VATRDS | KPPAPA | | DPCAS | QCRFFRSACS | |
| ASIP_MACFU | agouti | 6 | 6 | 0 | 5 | 10 | — | 0 | VATRDS | KPPAPA | | DPCAS | QCRFFRSACS | |
| ASIP_MACHE | agouti | 6 | 6 | 0 | 5 | 10 | — | 0 | VATRDS | KPPAPA | | DPCAF | QCRFFRSACS | |

TABLE 2-continued

| name | class | Loop 1 length | Loop 2 length | Loop 3 length | Loop 4 length | Loop 5 length | Loop 6 length | # 3D structures | Loop 1 | Loop 2 | Loop 3 | Loop 4 | Loop 5 | Loop 6 |
|---|---|---|---|---|---|---|---|---|---|---|---|---|---|---|
| ASIP_MACMR | agouti | 6 | 6 | 0 | 5 | 10 | — | 0 | VATRDS | KPPAPA | | DPCAS | QCRFFRSACS | |
| ASIP_MACMU | agouti | 6 | 6 | 0 | 5 | 10 | — | 0 | VATRDS | KPPAPA | | DPCAS | QCRFFRSACS | |
| ASIP_MACNE | agouti | 6 | 6 | 0 | 5 | 10 | — | 0 | VATRDS | KPPAPA | | DPCAS | QCRFFRSACS | |
| ASIP_MACNG | agouti | 6 | 6 | 0 | 5 | 10 | — | 0 | VATRDS | KSPAPA | | DPCAS | QCRFFRSACS | |
| ASIP_MACNR | agouti | 6 | 6 | 0 | 5 | 10 | — | 0 | VATRDS | KPPAPA | | DPCAS | QCRFFRSACS | |
| ASIP_MACRA | agouti | 6 | 6 | 0 | 5 | 10 | — | 0 | VATRDS | KPPAPA | | DPCAS | QCRFFRSACS | |
| ASIP_MACSI | agouti | 6 | 6 | 0 | 5 | 10 | — | 0 | VATRDS | KPPAPA | | DPCAS | QCRFFRSACS | |
| ASIP_MACSL | agouti | 6 | 6 | 0 | 5 | 10 | — | 0 | VTTRDS | KPPAPA | | DPCAS | QCRFFRSACS | |
| ASIP_MACSY | agouti | 6 | 6 | 0 | 5 | 10 | — | 0 | VATRDS | KPPAPA | | DPCAS | QCRFFGSACT | |
| ASIP_MOUSE | agouti | 6 | 6 | 0 | 5 | 10 | — | 0 | VATRDS | KPPAPA | | DPCAS | QCRFFRSACS | |
| ASIP_PANPA | agouti | 6 | 6 | 0 | 5 | 10 | — | 0 | VATRNS | KPPAPA | | DPCAS | QCRFFRSACS | |
| ASIP_PANTR | agouti | 6 | 6 | 0 | 5 | 10 | — | 0 | VATRNS | KPPAPA | | DPCAS | QCRFFRSACS | |
| ASIP_PAPAN | agouti | 6 | 6 | 0 | 5 | 10 | — | 0 | VANRDS | KPPALA | | DPCAF | QCRFFRSACS | |
| ASIP_PIG | agouti | 6 | 6 | 0 | 5 | 10 | — | 0 | VATRNS | KPPAPA | | DPCAS | QCRFFRSACS | |
| ASIP_PONPY | agouti | 6 | 6 | 0 | 5 | 10 | — | 0 | VATRDS | KPPAPA | | NPCAS | QCRFFGSACS | |
| ASIP_RAT | agouti | 6 | 6 | 0 | 5 | 10 | — | 0 | VATRYS | KPPAPA | | DPCAS | QCRFFRSACS | |
| ASIP_SEMEN | agouti | 6 | 6 | 0 | 5 | 10 | — | 0 | VATRDS | KPPAPA | | DPCAS | QCRFFRSACT | |
| ASIP_TRAAU | agouti | 6 | 6 | 0 | 5 | 10 | — | 0 | VATRDS | KPPAPA | | DPCAS | QCRFFRSACS | |
| ASIP_TRACR | agouti | 6 | 6 | 0 | 5 | 10 | — | 0 | VATRDS | KPPAPA | | DPCAS | QCRFFRSACS | |
| ASIP_TRAFR | agouti | 6 | 6 | 0 | 5 | 10 | — | 0 | VATRDS | KPPAPA | | DPCAS | QCRFFRSACS | |
| ASIP_TRAOB | agouti | 6 | 6 | 0 | 5 | 10 | — | 0 | VATRNS | KSPAPA | | DPCAS | QCRFFRSACT | |
| ASIP_VULVU | agouti | 6 | 6 | 0 | 5 | 10 | — | 0 | VATRDS | KPPAPV | | DPCAS | QCRFFRSVCT | |
| B0B577_RABIT | agouti | 6 | 6 | 0 | 5 | 10 | — | 0 | VPNFKT | KPHLNS | | NYCAL | KCRIFQTICQ | |
| B0ZDU0_COTJA | agouti | 6 | 6 | 0 | 5 | 10 | — | 0 | VPNFKT | KPHLNS | | NYCAL | KCRIFQTICQ | |
| B0ZDU2_CHICK | agouti | | | | | | | | | | | | | |

TABLE 2-continued

| name | class | Loop 1 length | Loop 2 length | Loop 3 length | Loop 4 length | Loop 5 length | Loop 6 length | # 3D structures | Loop 1 | Loop 2 | Loop 3 | Loop 4 | Loop 5 | Loop 6 |
|---|---|---|---|---|---|---|---|---|---|---|---|---|---|---|
| B0ZDU3_CHICK | agouti | 6 | 6 | 0 | 5 | 10 | — | 0 | VPNFKT | KPHLNS | | NYCAL | KCRIFQTICQ | |
| B0ZDU4_CHICK | agouti | 6 | 6 | 0 | 5 | 10 | — | 0 | VPNFKT | KPHLNS | | NYCAL | KCRIFQTICQ | |
| Q3UU47_MOUSE | agouti | 6 | 6 | 0 | 5 | 10 | — | 0 | VRLHES | LGQQVP | | DPCAT | YCRFFNAFCY | |
| Q4JNX9_CAPHI | agouti | 6 | 6 | 0 | 5 | 10 | — | 0 | VATRDS | KPPAPA | | DPCAF | QCRFFRSACS | |
| Q4SEW0_TETNG | agouti | 6 | 6 | 0 | 5 | 10 | — | 0 | IPHQQS | LGYPLP | | DPCDT | YCRFFNAICY | |
| Q4SP72_TETNG | agouti | 6 | 5 | 0 | 5 | 10 | — | 0 | SRLKDS | SPYMP | | DPCAS | HCRLFNTICN | |
| Q5CC33_CARAU | agouti | 6 | 6 | 0 | 5 | 10 | — | 0 | VPLWGS | KTPSAA | | DQCAF | HCRLFKTVCY | |
| Q5CC34_CARAU | agouti | 6 | 6 | 0 | 5 | 10 | — | 0 | VPLWGS | KTPSAA | | DQCAF | HCRLFKTVCY | |
| Q5CC35_CARAU | agouti | 6 | 6 | 0 | 5 | 10 | — | 0 | VPLWGS | KTPSAA | | DQCAF | HCRLFKTVCY | |
| Q5IRA5_CANFA | agouti | 6 | 6 | 0 | 5 | 10 | — | 0 | VATRNS | KSPAPA | | DPCAS | QCRFFRSACT | |
| Q68GX9_CANLU | agouti | 6 | 6 | 0 | 5 | 10 | — | 0 | VATRNS | KSPAPA | | DPCAS | QCRFFRSACT | |
| Q68GY0_CANLA | agouti | 6 | 6 | 0 | 5 | 10 | — | 0 | VATRNS | KSPAPA | | DPCAS | QCRFFRSACT | |
| Q6J648_SHEEP | agouti | 6 | 6 | 0 | 5 | 10 | — | 0 | VRLHES | LGHQVP | | DPCAT | YCRFFNAFCY | |
| Q70Q61_CARAU | agouti | 6 | 6 | 0 | 5 | 10 | — | 0 | IPHQQS | LGHHLP | | NPCDT | YCRFFKAFCY | |
| Q70Q62_CARAU | agouti | 6 | 6 | 0 | 5 | 10 | — | 0 | IPHQQS | LGHHLP | | NPCDT | YCRFFKAFCY | |
| Q90WY7_COTJA | agouti | 6 | 6 | 0 | 5 | 10 | — | 0 | VRLLES | LGHQIP | | DPCAT | YCRFFNAFCY | |
| Q9GLM5_PIG | agouti | 6 | 6 | 0 | 5 | 10 | — | 0 | VRLHES | LGHQVP | | DPCAT | YCRFFNAFCY | |
| Q9PWG2_CHICK | agouti | 6 | 6 | 0 | 5 | 10 | — | 0 | VRLLES | LGQQVP | | DLCAT | YCRFFKTCY | |
| Q9QX13_RAT | agouti | 6 | 6 | 0 | 5 | 9 | — | 0 | VRLLES | LGHQIP | | DPCAT | YCRFFNAFCY | |
| Q9W7R0_CHICK | agouti | 6 | 6 | 0 | 5 | 10 | — | 0 | VRLLES | LGHQIP | | DPCAT | YCRFFNAFCY | |
| 1AAL_AMAHP | alpha_amylase | 6 | 6 | 0 | 4 | 7 | — | 3 | IPKWNR | GPKMDGVP | | EPYT | TSDYYGN | |
| ADO1_AGRDO | bug | 6 | 6 | 0 | 4 | 6 | — | 1 | LPRGSK | LGENKQ | | KGTT | MFYANR | |
| IOB1_ISYOB | bug | 6 | 6 | 0 | 4 | 6 | — | 0 | LPRGSK | LGENKQ | | EKTT | MFYANR | |
| PTU1_PEITU | bug | 6 | 6 | 0 | 5 | 6 | — | 1 | LAPGAP | FGTDKP | | NPRAW | SSYANK | |
| A11GB | conoserver_frame-workVIVII | 6 | 8 | 0 | 3 | 3 | — | 0 | QRANFV | DAFHHAAV | | EGV | VLV | |
| ABVIA | conoserver_frame-workVIVII | 6 | 5 | 0 | 3 | 6 | — | 0 | SPPGSY | FGPAA | | SNF | STLSDV | |
| ABVIB | conoserver_frame-workVIVII | 6 | 5 | 0 | 3 | 6 | — | 0 | TPPGGA | GGHAH | | SQS | DILAST | |

TABLE 2-continued

| name | class | Loop 1 length | Loop 2 length | Loop 3 length | Loop 4 length | Loop 5 length | Loop 6 length | # 3D structures | Loop 1 | Loop 2 | Loop 3 | Loop 4 | Loop 5 | Loop 6 |
|---|---|---|---|---|---|---|---|---|---|---|---|---|---|---|
| ABVIC | conoserver_frame-workVIVII | 6 | 5 | 0 | 3 | 6 | — | 0 | TPPGGA | GGHAH | | SQS | NILAST | |
| ABVID | conoserver_frame-workVIVII | 6 | 5 | 0 | 3 | 6 | — | 0 | TPRHGV | FYSYF | | SKA | NPSSKR | |
| ABVIE | conoserver_frame-workVIVII | 6 | 5 | 0 | 3 | 4 | — | 0 | TPPEVG | LFAYE | | SKI | WRPR | |
| ABVIF | conoserver_frame-workVIVII | 6 | 5 | 0 | 3 | 6 | — | 0 | TPPGGY | YHPDP | | SQV | NFPRKH | |
| ABVIF mutant 1 | conoserver_frame-workVIVII | 6 | 5 | 0 | 3 | 6 | — | 0 | TPPGGY | YHPDP | | SQY | NFPRKH | |
| ABVIG | conoserver_frame-workVIVII | 6 | 5 | 0 | 3 | 6 | — | 0 | TAPGGA | YAAYT | | SNA | NLNTKK | |
| ABVIG mutant 1 | conoserver_frame-workVIVII | 6 | 5 | 0 | 3 | 6 | — | 0 | TAPGGA | YADNT | | SNA | NLNTKK | |
| ABVIH | conoserver_frame-workVIVII | 6 | 5 | 0 | 3 | 6 | — | 0 | TPAGDA | DATTK | | IPF | NLATKK | |
| ABVII | conoserver_frame-workVIVII | 6 | 5 | 0 | 3 | 6 | — | 0 | TPAGDA | DATTE | | ILF | NLATKK | |
| ABVIJ | conoserver_frame-workVIVII | 6 | 5 | 0 | 3 | 6 | — | 0 | TPAGDA | DATTE | | ILF | NLATKE | |
| ABVIK | conoserver_frame-workVIVII | 6 | 5 | 0 | 3 | 6 | — | 0 | TPAGGA | DATTE | | ILF | NLATKK | |
| ABVIL | conoserver_frame-workVIVII | 6 | 5 | 0 | 3 | 6 | — | 0 | TPGGEA | DATTN | | FLT | NLATNK | |
| ABVIM | conoserver_frame-workVIVII | 6 | 5 | 0 | 3 | 4 | — | 0 | LGSGEL | VRDTS | | SMS | TNNI | |
| ABVIN | conoserver_frame-workVIVII | 6 | 5 | 0 | 3 | 4 | — | 0 | LGSREQ | VRDTS | | SMS | TNNI | |
| ABVIO | conoserver_frame-workVIVII | 6 | 5 | 0 | 3 | 4 | — | 0 | LGSREL | VRDTS | | SMS | TNNI | |
| AVIA | conoserver_frame-workVIVII | 6 | 6 | 0 | 3 | 3 | — | 0 | SNAGAF | GIHPGL | | SEI | IVW | |
| Ai6.1 | conoserver_frame-workVIVII | 6 | 6 | 0 | 3 | 4 | — | 0 | KQSGEM | NLLDQN | | EGY | IVLV | |
| Ai6.2 | conoserver_frame-workVIVII | 6 | 6 | 0 | 3 | 4 | — | 0 | TQSGEL | DVIDPD | | NNF | IIFF | |
| Ai6.3 | conoserver_frame-workVIVII | 6 | 5 | 0 | 3 | 3 | — | 0 | YDGGTS | NTGNQ | | SGW | IFL | |
| Am2766 | conoserver_frame-workVIVII | 6 | 6 | 0 | 3 | 3 | — | 1 | KQAGES | DIFSQN | | VGT | AFI | |
| Ar6.1 | conoserver_frame-workVIVII | 6 | 6 | 0 | 3 | 3 | — | 0 | LEKGVL | DPSAGN | | SGE | VLV | |
| Ar6.10 | conoserver_frame-workVIVII | 6 | 4 | 0 | 4 | 7 | — | 0 | ADLGEE | YTRF | | PGLR | KDLQVPT | |
| Ar6.11 | conoserver_frame-workVIVII | 6 | 4 | 0 | 4 | 8 | — | 0 | GEQGEG | ATRP | | AGLS | VGSRPGGL | |
| Ar6.12 | conoserver_frame-workVIVII | 6 | 4 | 0 | 4 | 6 | — | 0 | GNLGES | SAHR | | PGLM | MGEASI | |
| Ar6.13 | conoserver_frame-workVIVII | 6 | 6 | 0 | 3 | 8 | — | 0 | SNFGSD | IPATHD | | SGE | FGFEDMGL | |

TABLE 2-continued

| name | class | Loop 1 length | Loop 2 length | Loop 3 length | Loop 4 length | Loop 5 length | Loop 6 length | # 3D structures | Loop 1 | Loop 2 | Loop 3 | Loop 4 | Loop 5 | Loop 6 |
|---|---|---|---|---|---|---|---|---|---|---|---|---|---|---|
| Ar6.14 | conoserver_framework VI VII | 6 | 5 | 0 | 3 | 6 | — | 0 | TPVGGY | SRHHH | | SNH | IKSIGR | |
| Ar6.15 | conoserver_framework VI VII | 6 | 5 | 0 | 3 | 6 | — | 0 | TPVGGY | FDHHH | | SNH | IKSIGR | |
| Ar6.16 | conoserver_framework VI VII | 6 | 5 | 0 | 3 | 6 | — | 0 | TPVGGY | SRHYH | | SNH | IKSIGR | |
| Ar6.17 | conoserver_framework VI VII | 6 | 5 | 0 | 3 | 6 | — | 0 | TPVGGS | SRHYH | | SLY | NKNIGQ | |
| Ar6.18 | conoserver_framework VI VII | 6 | 5 | 0 | 3 | 6 | — | 0 | SPNGGS | SRHYH | | SLW | NKDSGV | |
| Ar6.19 | conoserver_framework VI VII | 6 | 6 | 0 | 3 | 8 | — | 0 | TVDSDF | DPDNHD | | SGR | IDEGGSGV | |
| Ar6.2 | conoserver_framework VI VII | 6 | 8 | 0 | 3 | 3 | — | 0 | VDGGTF | GFPKIGGP | | SGW | IFV | |
| Ar6.20 | conoserver_framework VI VII | 3 | 6 | 0 | 8 | 3 | — | 0 | EES | EEEEKT | | GEXDGEPV | ARF | |
| Ar6.21 | conoserver_framework VI VII | 3 | 6 | 0 | 8 | 3 | — | 0 | EEY | EDEEKT | | GLEDGEPV | ATT | |
| Ar6.22 | conoserver_framework VI VII | 3 | 6 | 0 | 8 | 3 | — | 0 | EEY | EEEEKT | | GEEDGEPV | AEF | |
| Ar6.24 | conoserver_framework VI VII | 3 | 6 | 0 | 8 | 3 | — | 0 | EEY | EDEEKT | | GEEDGEPV | ARF | |
| Ar6.25 | conoserver_framework VI VII | 3 | 6 | 0 | 7 | 3 | — | 0 | EES | EEEEKH | | HENNGVYT | LRY | |
| Ar6.26 | conoserver_framework VI VII | 3 | 6 | 0 | 7 | 3 | — | 0 | EEN | EEEEKH | | NTNNGPS | APQ | |
| Ar6.27 | conoserver_framework VI VII | 3 | 6 | 0 | 7 | 3 | — | 0 | EES | EDEEKH | | NTNNGPS | APQ | |
| Ar6.28 | conoserver_framework VI VII | 3 | 6 | 0 | 8 | 3 | — | 0 | EES | EEEEKT | | GLENGQPF | SRI | |
| Ar6.3 | conoserver_framework VI VII | 6 | 9 | 0 | 3 | 3 | — | 0 | RALGEY | GLPYVHNSR | | SQL | GFI | |
| Ar6.4 | conoserver_framework VI VII | 6 | 6 | 0 | 2 | 4 | — | 0 | LPPLSL | TMADDE | | HD | ILFL | |
| Ar6.5 | conoserver_framework VI VII | 6 | 6 | 0 | 2 | 4 | — | 0 | LPPLSL | TMDDDE | | DD | ILFL | |
| Ar6.6 | conoserver_framework VI VII | 6 | 6 | 0 | 2 | 4 | — | 0 | LPPLSL | TMDDDE | | DD | XLFL | |
| Ar6.7 | conoserver_framework VI VII | 6 | 6 | 0 | 2 | 4 | — | 0 | LPPLHW | NMVDDE | | HF | VLLA | |
| Ar6.8 | conoserver_framework VI VII | 6 | 6 | 0 | 2 | 4 | — | 0 | LPPLSL | NMADDD | | ND | VLFL | |
| Ar6.9 | conoserver_framework VI VII | 6 | 4 | 0 | 4 | 7 | — | 0 | ADLGEE | HTRF | | PGLR | EDLQVPT | |
| AsVIIA | conoserver_framework VI VII | 6 | 5 | 0 | 3 | 10 | — | 0 | KQKGEG | SLDVE | | SSS | KPCGPLFDFD | |
| At6.1 | conoserver_framework VI VII | 6 | 5 | 0 | 3 | 5 | — | 0 | TPPGTY | VGPST | | SDV | SMSNV | |
| At6.2 | conoserver_framework VI VII | 6 | 5 | 0 | 3 | 6 | — | 0 | TPPSGY | YHPYY | | SRA | NLTRKR | |

TABLE 2-continued

| name | class | Loop 1 length | Loop 2 length | Loop 3 length | Loop 4 length | Loop 5 length | Loop 6 length | # 3D structures | Loop 1 | Loop 2 | Loop 3 | Loop 4 | Loop 5 | Loop 6 |
|---|---|---|---|---|---|---|---|---|---|---|---|---|---|---|
| At6.3 | conoserver_frame-workVIVII | 6 | 5 | 0 | 3 | 6 | — | 0 | THAYEA | DATTN | | YMT | NLPTRK | |
| At6.4 | conoserver_frame-workVIVII | 6 | 5 | 0 | 3 | 6 | — | 0 | TSPDGA | NTPPQ | | SKY | ISISTT | |
| At6.5 | conoserver_frame-workVIVII | 6 | 5 | 0 | 3 | 6 | — | 0 | THPGGA | AGHHH | | SQS | NTAANS | |
| At6.6 | conoserver_frame-workVIVII | 6 | 5 | 0 | 3 | 6 | — | 0 | TPPGGA | YYHSQ | | GDF | QRYINS | |
| At6.7 | conoserver_frame-workVIVII | 6 | 5 | 0 | 3 | 6 | — | 0 | TPPEGA | NHPSH | | EDF | DRGRNR | |
| At6.8 | conoserver_frame-workVIVII | 6 | 5 | 0 | 3 | 6 | — | 0 | TPPEGY | TYHRD | | DLY | NKTTNV | |
| Au6.1 | conoserver_frame-workVIVII | 6 | 6 | 0 | 3 | 3 | — | 0 | KAENEL | NIFIQN | | DGT | LLI | |
| Au6.2 | conoserver_frame-workVIVII | 6 | 6 | 0 | 2 | 4 | — | 0 | LEFGEL | NFFFPT | | GY | VLLV | |
| Au6.3 | conoserver_frame-workVIVII | 6 | 8 | 0 | 3 | 3 | — | 0 | EPPGNF | GMIKIGPP | | SGW | FFA | |
| BVIA | conoserver_frame-workVIVII | 6 | 6 | 0 | 3 | 3 | — | 0 | SAPGAF | LIRPGL | | SEF | FFA | |
| BeB42 | conoserver_frame-workVIVII | 6 | 5 | 0 | 3 | 6 | — | 0 | NDPGGS | TRHYH | | QLY | NKQESV | |
| BeB54 | conoserver_frame-workVIVII | 6 | 5 | 0 | 3 | 4 | — | 0 | KGWSVY | SWDWE | | SGE | TRYY | |
| Bromosleeper peptide | conoserver_frame-workVIVII | 3 | 6 | 0 | 7 | 3 | — | 0 | EET | NVTFKT | | GPPGDWQ | VEA | |
| C6.1 | conoserver_frame-workVIVII | 6 | 6 | 0 | 3 | 3 | — | 0 | SNAGAF | GIHPGL | | SEL | LGW | |
| C6.2 | conoserver_frame-workVIVII | 6 | 6 | 0 | 3 | 4 | — | 0 | KGKGAS | RRTSYD | | TGS | RSGR | |
| C6.3 | conoserver_frame-workVIVII | 6 | 6 | 0 | 3 | 4 | — | 0 | KGKGAS | RRTSYG | | TGS | RSGR | |
| C6.4 | conoserver_frame-workVIVII | 6 | 6 | 0 | 3 | 4 | — | 0 | KSTGAS | RRTPYD | | TGS | RSGR | |
| C6.5 | conoserver_frame-workVIVII | 6 | 6 | 0 | 3 | 4 | — | 0 | QGRGAS | RKTMYN | | SGS | RSGR | |
| C6.6 | conoserver_frame-workVIVII | 6 | 6 | 0 | 3 | 4 | — | 0 | QGRGAS | RKTSYD | | TGS | RSGR | |
| C6.7 | conoserver_frame-workVIVII | 6 | 6 | 0 | 3 | 4 | — | 0 | KSTGAS | RRTSYD | | TGS | DRGR | |
| C6.8 | conoserver_frame-workVIVII | 6 | 6 | 0 | 3 | 4 | — | 0 | QGRGAS | RRTSYD | | TGS | RSGR | |
| CVIA | conoserver_frame-workVIVII | 6 | 6 | 0 | 3 | 4 | — | 0 | KSTGAS | RRTSYD | | TGS | RSGR | |
| CVIB | conoserver_frame-workVIVII | 6 | 6 | 0 | 3 | 4 | — | 0 | KGKGAS | RKTMYD | | RGS | RSGR | |
| CVIC | conoserver_frame-workVIVII | 6 | 6 | 0 | 3 | 5 | — | 0 | KGKGQS | SKLMYD | | TGS | SRRGK | |
| CVID | conoserver_frame-workVIVII | 6 | 6 | 0 | 3 | 8 | — | 0 | KSKGAK | SKLMYD | | SGS | SGTVGR | |

TABLE 2-continued

| name | class | Loop 1 length | Loop 2 length | Loop 3 length | Loop 4 length | Loop 5 length | Loop 6 length | # 3D structures | Loop 1 | Loop 2 | Loop 3 | Loop 4 | Loop 5 | Loop 6 |
|---|---|---|---|---|---|---|---|---|---|---|---|---|---|---|
| CVIE | conoserver_frame-workVIVII | 6 | 6 | 0 | 3 | 3 | — | 0 | SNAGAF | GIHPGL | | SEL | LVW | |
| Ca6.1 | conoserver_frame-workVIVII | 6 | 6 | 0 | 3 | 3 | — | 0 | VDPGEF | GPGFGD | | TGF | LLV | |
| CaFr179 | conoserver_frame-workVIVII | 3 | 6 | 0 | 7 | 3 | — | 0 | EED | EDEEKH | | NTNNGPS | ARL | |
| CaHr91 | conoserver_frame-workVIVII | 6 | 6 | 0 | 4 | 8 | — | 0 | REQSQG | TNTSPP | | SGLR | SGQSQGGV | |
| Cn6.1 | conoserver_frame-workVIVII | 6 | 6 | 0 | 3 | 3 | — | 0 | YNAGTF | GIRPGL | | SEF | FLW | |
| CnVIA | conoserver_frame-workVIVII | 6 | 6 | 0 | 3 | 4 | — | 0 | YSTGTF | GINGGL | | SNL | LFFV | |
| CnVIIA | conoserver_frame-workVIVII | 6 | 6 | 0 | 3 | 6 | — | 0 | KGKGAP | TRLMYD | | HGS | SSSKGR | |
| Co6.1 | conoserver_frame-workVIVII | 6 | 5 | 0 | 3 | 6 | — | 0 | TPPGSH | TGHSD | | SDF | STMSDV | |
| Co6.2 | conoserver_frame-workVIVII | 6 | 5 | 0 | 3 | 6 | — | 0 | TPRNGV | FYSYF | | SRA | NPSTKR | |
| Co6.3 | conoserver_frame-workVIVII | 6 | 5 | 0 | 3 | 6 | — | 0 | TSPGGA | YSAST | | SKA | NLTTKR | |
| Co6.4 | conoserver_frame-workVIVII | 6 | 5 | 0 | 3 | 6 | — | 0 | MHPEGG | RFSYE | | SKI | YTPSFT | |
| Co6.5 | conoserver_frame-workVIVII | 6 | 5 | 0 | 3 | 6 | — | 0 | TPAGKA | DATAT | | VLF | NLVTNK | |
| Co6.6 | conoserver_frame-workVIVII | 6 | 5 | 0 | 3 | 6 | — | 0 | TDPGGA | GNPGH | | SKF | ITTSST | |
| Co6.7 | conoserver_frame-workVIVII | 6 | 5 | 0 | 3 | 5 | — | 0 | RLPGDL | AGDAS | | EHS | NIVHT | |
| Conotoxin-1 | conoserver_frame-workVIVII | 6 | 5 | 0 | 3 | 8 | — | 0 | DEEGTG | SSDSE | | SGR | TPEGLFEF | |
| Conotoxin-10 | conoserver_frame-workVIVII | 6 | 4 | 0 | 4 | 9 | — | 0 | GGQGEG | YTQP | | PGLR | RGGGTGGG A | |
| Conotoxin-12 | conoserver_frame-workVIVII | 6 | 4 | 0 | 4 | 9 | — | 0 | GGQGKG | YTQP | | PGLR | RGGGTGGG V | |
| Conotoxin-15 | conoserver_frame-workVIVII | 6 | 5 | 0 | 2 | 4 | — | 0 | RPSGSP | GVTSI | | GR | SRGK | |
| Conotoxin-2 | conoserver_frame-workVIVII | 6 | 4 | 0 | 4 | 9 | — | 0 | GGQGEG | YTQP | | PGLR | RGGGTGGG V | |
| Conotoxin-2/7 | conoserver_frame-workVIVII | 6 | 9 | 0 | 3 | 3 | — | 0 | IADDMP | GFGLFGGPL | | SGW | LFV | |
| Conotoxin-3 | conoserver_frame-workVIVII | 6 | 5 | 0 | 2 | 6 | — | 0 | ESYGKP | GIYND | | NA | DPAKKT | |
| Conotoxin-5 | conoserver_frame-workVIVII | 6 | 7 | 0 | 3 | 3 | — | 0 | REGGEF | GTLYEER | | SGW | FFV | |
| Conotoxin-6 | conoserver_frame-workVIVII | 6 | 7 | 0 | 3 | 3 | — | 0 | REGGEF | GTLYEER | | SGW | FFV | |
| Conotoxin-8 | conoserver_frame-workVIVII | 6 | 4 | 0 | 4 | 9 | — | 0 | GGQGEG | YTQP | | PGLR | RGGGTGGG S | |
| Conotoxin-9 | conoserver_frame-workVIVII | 6 | 6 | 0 | 3 | 3 | — | 0 | SSGGTF | GIHPGL | | SEF | FLW | |

TABLE 2-continued

| name | class | Loop 1 length | Loop 2 length | Loop 3 length | Loop 4 length | Loop 5 length | Loop 6 length | # 3D structures | Loop 1 | Loop 2 | Loop 3 | Loop 4 | Loop 5 | Loop 6 |
|---|---|---|---|---|---|---|---|---|---|---|---|---|---|---|
| Cv conotoxin | conoserver_frame-workVIVII | 6 | 8 | 0 | 3 | 3 | — | 0 | IAVGQL | VFWNIGRP | | SGL | VFA | |
| Da6.1 | conoserver_frame-workVIVII | 6 | 6 | 0 | 4 | 4 | — | 0 | RKEHQL | DLIFQN | | RGWY | LLRP | |
| Da6.2 | conoserver_frame-workVIVII | 6 | 6 | 0 | 4 | 4 | — | 0 | SEEGQL | DPLSQN | | RGWH | VLVS | |
| Da6.3 | conoserver_frame-workVIVII | 6 | 6 | 0 | 2 | 4 | — | 0 | LGGGEV | DIFFPQ | | GY | ILLF | |
| Da6.4 | conoserver_frame-workVIVII | 6 | 6 | 0 | 3 | 4 | — | 0 | AQSSEL | DALDSD | | SGV | MVFF | |
| Da6.5 | conoserver_frame-workVIVII | 6 | 5 | 0 | 3 | 3 | — | 0 | YDGGTG | DSGNQ | | SGW | IFV | |
| Da6.6 | conoserver_frame-workVIVII | 6 | 9 | 0 | 4 | 4 | — | 0 | QEKWDY | PVPFLGSRY | | DGFI | PSFF | |
| Da6.7 | conoserver_frame-workVIVII | 6 | 9 | 0 | 4 | 4 | — | 0 | QGEWEF | IVPVLGFVY | | PWLI | GPFV | |
| De7a | conoserver_frame-workVIVII | 6 | 7 | 0 | 3 | 4 | — | 0 | IPGGEN | DVFRPYR | | SGY | ILLL | |
| DeVIIA | conoserver_frame-workVIVII | 6 | 7 | 0 | 3 | 4 | — | 0 | KPKNNL | AITEMAE | | SGF | LIYR | |
| Di6.1 | conoserver_frame-workVIVII | 6 | 6 | 0 | 2 | 4 | — | 0 | LGFGEA | LMLYSD | | SY | VGAV | |
| Di6.2 | conoserver_frame-workVIVII | 6 | 6 | 0 | 3 | 4 | — | 0 | YLLVHF | GINGGL | | SNL | LFFV | |
| Di6.3 | conoserver_frame-workVIVII | 6 | 5 | 0 | 3 | 6 | — | 0 | NEAQEH | TQNPD | | SES | NKFVGR | |
| E6.1 | conoserver_frame-workVIVII | 6 | 6 | 0 | 3 | 4 | — | 0 | KPKGRK | FPHQKD | | NKT | TRSK | |
| E6.2 | conoserver_frame-workVIVII | 6 | 5 | 0 | 2 | 6 | — | 0 | TPHGGS | GLVST | | GR | SVPRNK | |
| EVIA | conoserver_frame-workVIVII | 6 | 9 | 0 | 3 | 3 | — | 2 | IKXYGF | SLPILKNGL | | SGA | VGV | |
| EVIB | conoserver_frame-workVIVII | 6 | 6 | 0 | 3 | 4 | — | 0 | YPPGTF | GIKPGL | | SEL | LPAV | |
| Eb6.1 | conoserver_frame-workVIVII | 6 | 5 | 0 | 3 | 6 | — | 0 | THSGGA | NSHDQ | | NAF | DTATRT | |
| Eb6.10 | conoserver_frame-workVIVII | 6 | 5 | 0 | 3 | 6 | — | 0 | TRSGGA | NSHTQ | | DDF | DTATRT | |
| Eb6.11 | conoserver_frame-workVIVII | 6 | 5 | 0 | 3 | 6 | — | 0 | TRSGGA | NSHTQ | | NAF | DTATRT | |
| Eb6.12 | conoserver_frame-workVIVII | 6 | 5 | 0 | 3 | 6 | — | 0 | TRSGGA | NSHTQ | | DDF | STATST | |
| Eb6.13 | conoserver_frame-workVIVII | 6 | 5 | 0 | 3 | 6 | — | 0 | TQTNGA | YHRDT | | SKS | NLTINR | |
| Eb6.2 | conoserver_frame-workVIVII | 6 | 5 | 0 | 3 | 6 | — | 0 | AHSGGA | NSHDQ | | NAF | DTATRT | |
| Eb6.3 | conoserver_frame-workVIVII | 6 | 5 | 0 | 3 | 6 | — | 0 | THSGGA | NSHDQ | | NAF | DTATRA | |
| Eb6.4 | conoserver_frame-workVIVII | 6 | 5 | 0 | 3 | 6 | — | 0 | THSGGA | NSHDQ | | NTF | DTATRT | |

TABLE 2-continued

| name | class | Loop 1 length | Loop 2 length | Loop 3 length | Loop 4 length | Loop 5 length | Loop 6 length | # 3D structures | Loop 1 | Loop 2 | Loop 3 | Loop 4 | Loop 5 | Loop 6 |
|---|---|---|---|---|---|---|---|---|---|---|---|---|---|---|
| Eb6.5 | conoserver_frame-workVIVII | 6 | 5 | 0 | 3 | 6 | — | 0 | TRSGGA | NSHDQ | | NAF | DTATRT | |
| Eb6.6 | conoserver_frame-workVIVII | 6 | 5 | 0 | 3 | 6 | — | 0 | THSGGA | NSHNQ | | NAF | DTATRT | |
| Eb6.8 | conoserver_frame-workVIVII | 6 | 5 | 0 | 3 | 6 | — | 0 | THSGGA | NSHTQ | | DDF | STATST | |
| Eb6.9 | conoserver_frame-workVIVII | 6 | 5 | 0 | 3 | 6 | — | 0 | TRSGGA | NSHTQ | | DDF | STATST | |
| Ep6.1 | conoserver_frame-workVIVII | 6 | 6 | 0 | 2 | 4 | — | 0 | LGFGEA | LMLYSD | | SY | VALV | |
| G6.1 | conoserver_frame-workVIVII | 6 | 8 | 0 | 3 | 3 | — | 0 | EPPGDF | GFFKIGPP | | SGW | FLW | |
| GVIA | conoserver_frame-workVIVII | 6 | 6 | 0 | 2 | 6 | — | 3 | KSPGSS | SPTSYN | | RS | NPYTKR | |
| GVIIA | conoserver_frame-workVIVII | 6 | 6 | 0 | 2 | 6 | — | 0 | KSPGTP | SRGMRD | | TS | LLYSNK | |
| GVIIB | conoserver_frame-workVIVII | 6 | 6 | 0 | 2 | 6 | — | 0 | KSPGTP | SRGMRD | | TS | LSYSNK | |
| Ge6.1 | conoserver_frame-workVIVII | 6 | 8 | 0 | 3 | 3 | — | 0 | LDPGYF | GTPFLGAY | | GGI | LIV | |
| Gla(1)-TxVI | conoserver_frame-workVIVII | 6 | 5 | 0 | 3 | 3 | — | 0 | KDGLTT | LAPSE | | SED | EGS | |
| Gla(2)-TxVI/A | conoserver_frame-workVIVII | 6 | 5 | 0 | 3 | 3 | — | 0 | SDDWQY | ESPTD | | SWD | DW | |
| Gla(2)-TxVI/B | conoserver_frame-workVIVII | 6 | 5 | 0 | 3 | 3 | — | 0 | SDDWQY | ESPTD | | SWD | DW | |
| Gla(3)-TxVI | conoserver_frame-workVIVII | 6 | 5 | 0 | 3 | 4 | — | 0 | PDYTEP | SHAHE | | SWN | YNGH | |
| Gm6.1 | conoserver_frame-workVIVII | 6 | 8 | 0 | 3 | 3 | — | 0 | RLGAES | DVISQN | | QGT | VFF | |
| Gm6.2 | conoserver_frame-workVIVII | 6 | 6 | 0 | 3 | 3 | — | 0 | KQADES | NVFSLD | | TGL | LGF | |
| Gm6.3 | conoserver_frame-workVIVII | 6 | 6 | 0 | 3 | 3 | — | 0 | VPYEGP | NWLTQN | | DEL | VFF | |
| Gm6.4 | conoserver_frame-workVIVII | 6 | 5 | 0 | 3 | 3 | — | 0 | YDGGTG | DSGNQ | | SGW | IFA | |
| Gm6.5 | conoserver_frame-workVIVII | 6 | 9 | 0 | 4 | 4 | — | 0 | QALWDY | PVPLLSSGD | | YGLI | GPFV | |
| GmVIA | conoserver_frame-workVIVII | 6 | 6 | 0 | 4 | 3 | — | 0 | RKEGQL | DPIFQN | | RGWN | VLF | |
| Im6.1 | conoserver_frame-workVIVII | 4 | 5 | 0 | 5 | 8 | — | 0 | DPYY | NDGKV | | PEYPT | GDSTGKLI | |
| J6.1 | conoserver_frame-workVIVII | 6 | 5 | 0 | 3 | 6 | — | 0 | TRPGGA | YYDSH | | RHV | HEVFNT | |
| J6.2 | conoserver_frame-workVIVII | 6 | 5 | 0 | 3 | 6 | — | 0 | TPPGGA | NIHPH | | EEF | DMANNR | |
| King-Kong 1 | conoserver_frame-workVIVII | 6 | 6 | 0 | 3 | 4 | — | 0 | IEQFDP | EMIRHT | | VGV | FLMA | |
| King-Kong 2 | conoserver_frame-workVIVII | 6 | 6 | 0 | 3 | 4 | — | 0 | APFLHP | TFFFPN | | NSY | VQFI | |

TABLE 2-continued

| name | class | Loop 1 length | Loop 2 length | Loop 3 length | Loop 4 length | Loop 5 length | Loop 6 length | # 3D structures | Loop 1 | Loop 2 | Loop 3 | Loop 4 | Loop 5 | Loop 6 |
|---|---|---|---|---|---|---|---|---|---|---|---|---|---|---|
| LVVICa | conoserver_frame-workVIVII | 6 | 5 | 0 | 3 | 6 | — | 0 | TPRNGF | RYHSD | | SNF | HTWAIM | |
| LeD51 | conoserver_frame-workVIVII | 6 | 5 | 0 | 3 | 3 | — | 0 | KDGLTT | LAPSE | | SGN | EQN | |
| LiC42 | conoserver_frame-workVIVII | 6 | 4 | 0 | 4 | 8 | — | 0 | GHSGAG | YTRP | | PGLH | SGGHAGGL | |
| LiC53 | conoserver_frame-workVIVII | 6 | 5 | 0 | 3 | 4 | — | 0 | TAPSGY | DYPEE | | EVE | GRHY | |
| LiCr173 | conoserver_frame-workVIVII | 3 | 6 | 0 | 8 | 3 | — | 0 | NEY | EERDRN | | GKANGEPR | ARM | |
| LiCr95 | conoserver_frame-workVIVII | 6 | 6 | 0 | 3 | 8 | — | 0 | DPPGDS | SRWYNH | | SKL | TSRNSGPT | |
| Lp6.1 | conoserver_frame-workVIVII | 6 | 9 | 0 | 3 | 3 | — | 0 | VELGEI | ATGFFLDEE | | TGS | HVF | |
| LI7b | conoserver_frame-workVIVII | 6 | 5 | 0 | 3 | 3 | — | 0 | TDWLGS | SSPSE | | YDN | ETY | |
| LtVIA | conoserver_frame-workVIVII | 6 | 4 | 0 | 4 | 7 | — | 0 | AYISEP | DILP | | PGLK | NEDFVPI | |
| LtVIB | conoserver_frame-workVIVII | 6 | 5 | 0 | 3 | 6 | — | 0 | SSPDES | TYHYN | | QLY | NKEENV | |
| LtVIC | conoserver_frame-workVIVII | 6 | 5 | 0 | 2 | 6 | — | 0 | KVAGSP | GLVSE | | GT | NVLRNR | |
| LtVID | conoserver_frame-workVIVII | 6 | 6 | 0 | 3 | 8 | — | 0 | TDEGGD | DPGNHN | | RGS | LVLQHKAV | |
| LtVIE | conoserver_frame-workVIVII | 6 | 6 | 0 | 3 | 8 | — | 0 | TDEGGD | DPGNHN | | RGS | LVLQHKAV | |
| LtVIIA | conoserver_frame-workVIVII | 6 | 5 | 0 | 3 | 4 | — | 0 | LGWSNY | TSHSI | | SGE | ILSY | |
| Lv6.1 | conoserver_frame-workVIVII | 6 | 6 | 0 | 3 | 4 | — | 0 | PNTGEL | DWEQN | | YTY | FIVV | |
| LvVIA 1 | conoserver_frame-workVIVII | 6 | 5 | 0 | 4 | 6 | — | 0 | SPAGEV | TSKSP | | TGFL | SHIGGM | |
| LvVIA 2 | conoserver_frame-workVIVII | 6 | 5 | 0 | 4 | 6 | — | 0 | SPAGEV | TSKSP | | TGFL | THIGGM | |
| LvVIA 3 | conoserver_frame-workVIVII | 6 | 5 | 0 | 4 | 6 | — | 0 | SPGGEV | TSKSP | | TGFL | SHIGGM | |
| LvVIB 1 | conoserver_frame-workVIVII | 6 | 5 | 0 | 4 | 6 | — | 0 | SPGGEV | TRHSP | | TGFL | NHIGGM | |
| LvVIB 2 | conoserver_frame-workVIVII | 6 | 5 | 0 | 4 | 6 | — | 0 | SPGGEV | TRHSP | | TGFL | NHIGGM | |
| LvVICb | conoserver_frame-workVIVII | 6 | 5 | 0 | 3 | 6 | — | 0 | TPRNGF | RYHSH | | SNF | HTWAIM | |
| LvVID | conoserver_frame-workVIVII | 6 | 5 | 0 | 3 | 6 | — | 0 | TPRNGA | GYHSH | | SNF | HTWANV | |
| M1 | conoserver_frame-workVIVII | 6 | 5 | 0 | 3 | 6 | — | 0 | TPSGGA | YVAST | | SNA | NLNSNK | |
| M12 | conoserver_frame-workVIVII | 6 | 5 | 0 | 3 | 6 | — | 0 | TPRHGV | FYSYF | | SKA | NPSSKR | |
| M15 | conoserver_frame-workVIVII | 6 | 5 | 0 | 3 | 6 | — | 0 | TPPGGS | GGHAH | | SKS | NIMAST | |

TABLE 2-continued

| name | class | Loop 1 length | Loop 2 length | Loop 3 length | Loop 4 length | Loop 5 length | Loop 6 length | # 3D structures | Loop 1 | Loop 2 | Loop 3 | Loop 4 | Loop 5 | Loop 6 |
|---|---|---|---|---|---|---|---|---|---|---|---|---|---|---|
| M19 | conoserver_framework VI VII | 6 | 5 | 0 | 3 | 4 | — | 0 | LGSGEQ | VRDTS | | SMS | TNNI | |
| M23 | conoserver_framework VI VII | 6 | 5 | 0 | 3 | 6 | — | 0 | SPPGSY | FGPAA | | SNF | STMSDV | |
| M25 | conoserver_framework VI VII | 6 | 5 | 0 | 3 | 4 | — | 0 | TPPEGG | LSSYE | | SKI | WRPR | |
| M26 | conoserver_framework VI VII | 6 | 5 | 0 | 3 | 6 | — | 0 | TPAGDA | DATTN | | ILF | NLATKK | |
| M6.1 | conoserver_framework VI VII | 6 | 6 | 0 | 3 | 3 | — | 0 | KQADEP | DVFSLE | | TGI | LGF | |
| M6.2 | conoserver_framework VI VII | 6 | 6 | 0 | 3 | 4 | — | 0 | YNAGTF | GIKPGL | | SAI | LSFV | |
| MVIA | conoserver_framework VI VII | 6 | 6 | 0 | 3 | 3 | — | 0 | YNAGTF | GIRPGL | | SEF | FLW | |
| MVIB | conoserver_framework VI VII | 6 | 6 | 0 | 3 | 3 | — | 0 | YNAGSF | GIHPGL | | SEF | ILW | |
| MVIC | conoserver_framework VI VII | 6 | 6 | 0 | 3 | 4 | — | 0 | YPPGTF | GIKPGL | | SAI | LSFV | |
| MVID | conoserver_framework VI VII | 6 | 6 | 0 | 3 | 4 | — | 0 | YNAGTF | GIKPGL | | SAI | LSFV | |
| MVIIA | conoserver_framework VI VII | 6 | 6 | 0 | 3 | 4 | — | 5 | KGKGAK | SRLMYD | | TGS | RSGK | |
| MVIIB | conoserver_framework VI VII | 6 | 6 | 0 | 3 | 4 | — | 0 | KGKGAS | HRTSYD | | TGS | NRGK | |
| MVIIC | conoserver_framework VI VII | 6 | 6 | 0 | 3 | 5 | — | 2 | KGKGAP | RKTMYD | | SGS | GRRGK | |
| MVIID | conoserver_framework VI VII | 6 | 6 | 0 | 3 | 4 | — | 0 | QGRGAS | RKTMYN | | SGS | NRGR | |
| MaI51 | conoserver_framework VI VII | 6 | 5 | 0 | 3 | 3 | — | 0 | EDVWMP | TSNWE | | SLD | EMY | |
| MaIr137 | conoserver_framework VI VII | 6 | 8 | 0 | 3 | 3 | — | 0 | EPPGDF | GFFKIGPP | | SGW | FLW | |
| MaIr193 | conoserver_framework VI VII | 6 | 8 | 0 | 3 | 3 | — | 0 | RPPGMV | GFPKPGPY | | SGW | FAV | |
| MaIr332 | conoserver_framework VI VII | 6 | 6 | 0 | 3 | 4 | — | 0 | LDGGEI | GILFPS | | SGW | IVLV | |
| MaIr34 | conoserver_framework VI VII | 6 | 9 | 0 | 3 | 3 | — | 0 | LEADYY | VLPFVGNGM | | SGI | VFV | |
| MaIr94 | conoserver_framework VI VII | 6 | 8 | 0 | 3 | 10 | — | 0 | LESGSL | EAGYGHSS | | SGA | LDYGGLGVGA | |
| MgJ42 | conoserver_framework VI VII | 6 | 5 | 0 | 3 | 6 | — | 0 | NNRGGG | SQHPH | | SGT | NKITFGV | |
| MgJr112 | conoserver_framework VI VII | 6 | 5 | 0 | 4 | 4 | — | 0 | DPKWTI | NNDAE | | FPYS | ENSN | |
| MgJr93 | conoserver_framework VI VII | 6 | 5 | 0 | 3 | 6 | — | 0 | NNRGGG | SQHPH | | SGT | NKIFGV | |
| MgJr94 | conoserver_framework VI VII | 6 | 5 | 0 | 3 | 7 | — | 0 | KGKGAG | DYSHE | | SRQ | TGRIFQT | |
| MiEr92 | conoserver_framework VI VII | 6 | 6 | 0 | 4 | 8 | — | 0 | KHQNDS | AEEGEE | | SDLR | MTSGAGAI | |

TABLE 2-continued

| name | class | Loop 1 length | Loop 2 length | Loop 3 length | Loop 4 length | Loop 5 length | Loop 6 length | # 3D structures | Loop 1 | Loop 2 | Loop 3 | Loop 4 | Loop 5 | Loop 6 |
|---|---|---|---|---|---|---|---|---|---|---|---|---|---|---|
| MiEr93 | conoserver_frame-workVIVII | 6 | 5 | 0 | 3 | 6 | — | 0 | NDRGGG | SQHPH | | GGT | NKLIGV | |
| MiEr95 | conoserver_frame-workVIVII | 6 | 5 | 0 | 4 | 8 | — | 0 | REKGQG | TNTAL | | PGLE | EGQSQGGL | |
| MiK41 | conoserver_frame-workVIVII | 6 | 5 | 0 | 3 | 6 | — | 0 | RSSGRY | RSPYD | | RRY | RRITDA | |
| MiK42 | conoserver_frame-workVIVII | 6 | 6 | 0 | 2 | 9 | — | 0 | DAPNAP | EKFDND | | DA | MLREKQQPI | |
| MI6.1 | conoserver_frame-workVIVII | 6 | 5 | 0 | 3 | 6 | — | 0 | TPPGSD | NGHSD | | SNV | STMSYV | |
| MI6.2 | conoserver_frame-workVIVII | 6 | 5 | 0 | 3 | 6 | — | 0 | TPRNGY | YYRYF | | SRA | NLTIKR | |
| MI6.3 | conoserver_frame-workVIVII | 6 | 5 | 0 | 3 | 6 | — | 0 | TPSGGA | YYDYF | | SMT | NFNSKS | |
| MI6.4 | conoserver_frame-workVIVII | 6 | 6 | 0 | 2 | 8 | — | 0 | ADGGDL | DPSSDN | | SE | IDEGGSGV | |
| Mr6.1 | conoserver_frame-workVIVII | 6 | 6 | 0 | 3 | 4 | — | 0 | LDAGEM | DLFNSK | | SGW | IILF | |
| Mr6.2 | conoserver_frame-workVIVII | 6 | 6 | 0 | 3 | 4 | — | 0 | PNTGEL | DVVEQN | | YTY | FIVV | |
| Mr6.3 | conoserver_frame-workVIVII | 6 | 6 | 0 | 3 | 4 | — | 0 | PNTGEL | DVVEQN | | YTY | FIVV | |
| MrVIA | conoserver_frame-workVIVII | 6 | 9 | 0 | 4 | 4 | — | 0 | RKKWEY | IVPIIGFIY | | PGLI | GPFV | |
| MrVIB | conoserver_frame-workVIVII | 6 | 9 | 0 | 4 | 4 | — | 1 | SKKWEY | IVPILGFVY | | PGLI | GPFV | |
| NgVIA | conoserver_frame-workVIVII | 6 | 6 | 0 | 3 | 4 | — | 0 | FSPGTF | GIKPGL | | SVR | FSLF | |
| Om6.1 | conoserver_frame-workVIVII | 6 | 6 | 0 | 4 | 4 | — | 0 | VPHEGP | NWLTQN | | SGYN | IIFF | |
| Om6.2 | conoserver_frame-workVIVII | 6 | 6 | 0 | 3 | 3 | — | 0 | LAEHET | NIFTQN | | EGV | IFI | |
| Om6.3 | conoserver_frame-workVIVII | 6 | 6 | 0 | 3 | 4 | — | 0 | IPHFDP | DPIRHT | | FGL | LLLA | |
| Om6.4 | conoserver_frame-workVIVII | 6 | 6 | 0 | 2 | 4 | — | 0 | LGFGEA | LILYSD | | GY | VGAI | |
| Om6.5 | conoserver_frame-workVIVII | 6 | 8 | 0 | 3 | 3 | — | 0 | EPPGNF | GMIKIGPP | | SGW | FFA | |
| Om6.6 | conoserver_frame-workVIVII | 6 | 9 | 0 | 4 | 4 | — | 0 | QRRWDF | PGSLVGVIT | | GGLI | FLFF | |
| P2a | conoserver_frame-workVIVII | 6 | 6 | 0 | 3 | 4 | — | 0 | KTPGRK | FPHQKD | | GRA | IITI | |
| P2b | conoserver_frame-workVIVII | 6 | 6 | 0 | 3 | 4 | — | 0 | KKSGRK | FPHQKD | | GRA | IITI | |
| P2c | conoserver_frame-workVIVII | 6 | 6 | 0 | 3 | 4 | — | 0 | KKTGRK | FPHQKD | | GRA | IITI | |
| P6.1 | conoserver_frame-workVIVII | 6 | 6 | 0 | 3 | 4 | — | 0 | YPPGTF | GIKPGL | | SEL | LPAV | |
| PVIA | conoserver_frame-workVIVII | 6 | 6 | 0 | 3 | 4 | — | 0 | YAPGTF | GIKPGL | | SEF | LPGV | |

TABLE 2-continued

| name | class | Loop 1 length | Loop 2 length | Loop 3 length | Loop 4 length | Loop 5 length | Loop 6 length | # 3D structures | Loop 1 | Loop 2 | Loop 3 | Loop 4 | Loop 5 | Loop 6 |
|---|---|---|---|---|---|---|---|---|---|---|---|---|---|---|
| PVIIA | conoserver_frame-workVIVII | 6 | 6 | 0 | 3 | 5 | — | 2 | RIPNQK | FQHLDD | | SRK | NRFNK | |
| Pn6.1 | conoserver_frame-workVIVII | 6 | 6 | 0 | 3 | 4 | — | 0 | VKYLDP | DMLRHT | | FGL | VLIA | |
| Pn6.10 | conoserver_frame-workVIVII | 3 | 6 | 0 | 8 | 3 | — | 0 | EES | EDEEKH | | HENNGVYT | LRY | |
| Pn6.11 | conoserver_frame-workVIVII | 3 | 6 | 0 | 8 | 3 | — | 0 | EEY | EDEEKT | | GLEDGEPV | ATT | |
| Pn6.12 | conoserver_frame-workVIVII | 6 | 5 | 0 | 3 | 3 | — | 0 | FESWVA | ESPKR | | SHV | LFV | |
| Pn6.13 | conoserver_frame-workVIVII | 6 | 6 | 0 | 3 | 3 | — | 0 | IAESEP | NIITQN | | DGK | LFF | |
| Pn6.14 | conoserver_frame-workVIVII | 6 | 9 | 0 | 4 | 4 | — | 0 | QRRWDF | PGALVGVIT | | GGLI | LGVM | |
| Pn6.2 | conoserver_frame-workVIVII | 6 | 6 | 0 | 2 | 4 | — | 0 | LGFGEV | NFFFPN | | SY | VALV | |
| Pn6.3 | conoserver_frame-workVIVII | 6 | 6 | 0 | 3 | 4 | — | 0 | IPQFDP | DMVRHT | | KGL | VLIA | |
| Pn6.5 | conoserver_frame-workVIVII | 6 | 6 | 0 | 3 | 3 | — | 0 | KAESEA | NIITQN | | DGK | LFF | |
| Pn6.6 | conoserver_frame-workVIVII | 6 | 5 | 0 | 3 | 3 | — | 0 | FESWVA | ESPKR | | SHV | LFV | |
| Pn6.7 | conoserver_frame-workVIVII | 6 | 9 | 0 | 3 | 3 | — | 0 | LEVDYF | GIPFVNNGL | | SGN | VFV | |
| Pn6.8 | conoserver_frame-workVIVII | 6 | 5 | 0 | 3 | 3 | — | 0 | SDQWKS | SYPHE | | RWS | NRY | |
| Pn6.9 | conoserver_frame-workVIVII | 6 | 5 | 0 | 3 | 3 | — | 0 | DDWLAA | TTPSQ | | TEV | DGF | |
| PnVIA | conoserver_frame-workVIVII | 6 | 9 | 0 | 3 | 3 | — | 0 | LEVDYF | GIPFANNGL | | SGN | VFV | |
| PnVIB | conoserver_frame-workVIVII | 6 | 8 | 0 | 3 | 3 | — | 0 | EPPGNF | GMIKIGPP | | SGW | FFA | |
| PnVIIA | conoserver_frame-workVIVII | 6 | 5 | 0 | 3 | 4 | — | 0 | TSWFGR | TVNSE | | SNS | DQTY | |
| Pu6.1 | conoserver_frame-workVIVII | 6 | 6 | 0 | 3 | 3 | — | 0 | VEDGDF | GPGYEE | | SGF | LYV | |
| PuIA | conoserver_frame-workVIVII | 6 | 9 | 0 | 3 | 3 | — | 0 | RPVGQY | GIPYEHNWR | | SQL | AII | |
| PuIIA | conoserver_frame-workVIVII | 6 | 5 | 0 | 3 | 6 | — | 0 | NTPTQY | TLHRH | | SLY | HKTIHA | |
| Qc6.1 | conoserver_frame-workVIVII | 6 | 9 | 0 | 3 | 3 | — | 0 | AAAGEA | VIPIIGNVF | | KGY | LFV | |
| Qc6.2 | conoserver_frame-workVIVII | 6 | 8 | 0 | 3 | 3 | — | 0 | QDSGVV | GFPKPEPH | | SGW | LFV | |
| QcVIA | conoserver_frame-workVIVII | 2 | 3 | 0 | 4 | 4 | — | 0 | PW | GFT | | LPNY | QGLT | |
| RVIA | conoserver_frame-workVIVII | 6 | 6 | 0 | 2 | 6 | — | 0 | KPPGSP | RVSSYN | | SS | KSYNKK | |
| RVIIA | conoserver_frame-workVIVII | 6 | 5 | 0 | 3 | 4 | — | 0 | TYWLGP | EVDDT | | SAS | ESKF | |

TABLE 2-continued

| name | class | Loop 1 length | Loop 2 length | Loop 3 length | Loop 4 length | Loop 5 length | Loop 6 length | # 3D structures | Loop 1 | Loop 2 | Loop 3 | Loop 4 | Loop 5 | Loop 6 |
|---|---|---|---|---|---|---|---|---|---|---|---|---|---|---|
| S6.1 | conoserver_framework VI VII | 6 | 6 | 0 | 3 | 4 | — | 0 | KAAGKS | SRIAYN | | TGS | RSGK | |
| S6.10 | conoserver_framework VI VII | 6 | 5 | 0 | 3 | 6 | — | 0 | TPDDGA | AEPVQ | | STF | NPVTNM | |
| S6.11 | conoserver_framework VI VII | 6 | 5 | 0 | 3 | 4 | — | 0 | RTWNAP | SFTSQ | | FGK | AHHR | |
| S6.2 | conoserver_framework VI VII | 6 | 5 | 0 | 2 | 4 | — | 0 | RSSGSP | GVTGI | | GR | YRGK | |
| S6.6 | conoserver_framework VI VII | 6 | 6 | 0 | 3 | 5 | — | 0 | KGKGAP | RKTMYD | | SGS | GRRGK | |
| S6.7 | conoserver_framework VI VII | 6 | 6 | 0 | 2 | 8 | — | 0 | MEAGSY | GSTTRI | | GY | AYSASKNV | |
| S6.8 | conoserver_framework VI VII | 6 | 6 | 0 | 3 | 3 | — | 0 | SNAGGF | GIHPGL | | SEI | LVW | |
| SO3 | conoserver_framework VI VII | 6 | 6 | 0 | 3 | 4 | — | 1 | KAAGKP | SRIAYN | | TGS | RSGK | |
| SO4 | conoserver_framework VI VII | 6 | 7 | 0 | 2 | 6 | — | 0 | IEAGNY | GPTVMKI | | GF | SPYSKI | |
| SO5 | conoserver_framework VI VII | 6 | 6 | 0 | 2 | 6 | — | 0 | MEAGSY | GSTTRI | | GY | AYFGKK | |
| SVIA | conoserver_framework VI VII | 6 | 5 | 0 | 2 | 4 | — | 0 | RSSGSP | GVTSI | | GR | YRGK | |
| SVIA mutant 1 | conoserver_framework VI VII | 6 | 5 | 0 | 2 | 4 | — | 0 | RPSGSP TABLE 2-continued

| name | class | Loop 1 length | Loop 2 length | Loop 3 length | Loop 4 length | Loop 5 length | Loop 6 length | # 3D structures | Loop 1 | Loop 2 | Loop 3 | Loop 4 | Loop 5 | Loop 6 |
|---|---|---|---|---|---|---|---|---|---|---|---|---|---|---|
| Ts6.3 | conoserver_framework_VIVII | 6 | 5 | 0 | 3 | 3 | — | 0 | TPWLGG | TSPEE | | PGN | ETY | |
| Ts6.4 | conoserver_framework_VIVII | 3 | 6 | 0 | 8 | 3 | — | 0 | NEY | DDRNKE | | GRTNGHPR | ANV | |
| Ts6.5 | conoserver_framework_VIVII | 3 | 6 | 0 | 8 | 3 | — | 0 | NEH | EDRNKE | | GRTNGHPR | ANV | |
| Ts6.6 | conoserver_framework_VIVII | 3 | 6 | 0 | 8 | 3 | — | 0 | NEY | DDRNKE | | GRTNGHPR | ANV | |
| Ts6.7 | conoserver_framework_VIVII | 3 | 6 | 0 | 8 | 3 | — | 0 | DEY | EDLNKN | | GLSNGEPV | AIA | |
| Tx6.1 | conoserver_framework_VIVII | 6 | 6 | 0 | 4 | 4 | — | 0 | RKEHQL | DLIFQN | | RGWY | VVLS | |
| Tx6.2 | conoserver_framework_VIVII | 6 | 6 | 0 | 3 | 4 | — | 0 | APFLHL | TFFFPN | | NGY | VQFI | |
| Tx6.3 | conoserver_framework_VIVII | 6 | 5 | 0 | 3 | 4 | — | 0 | YDSGTS | NTGNQ | | SGW | IFVS | |
| Tx6.4 | conoserver_framework_VIVII | 6 | 8 | 0 | 3 | 3 | — | 0 | EPPGNF | GMIKIGPP | | SGW | FFA | |
| TxIA/TxVIA | conoserver_framework_VIVII | 6 | 6 | 0 | 3 | 4 | — | 2 | KQSGEM | NLLDQN | | DGY | IVLV | |
| TxIB/TxVIB | conoserver_framework_VIVII | 6 | 6 | 0 | 3 | 4 | — | 0 | KQSGEM | NVLDQN | | DGY | IVFV | |
| TxMEKL-011 | conoserver_framework_VIVII | 6 | 5 | 0 | 3 | 3 | — | 0 | KDGLTT | LAPSE | | SGN | EQN | |
| TxMEKL-022/TxMEKL-021 | conoserver_framework_VIVII | 6 | 5 | 0 | 3 | 5 | — | 0 | TSWLAT | TDASQ | | TGV | YKRAY | |
| TxMEKL-0511/TxMEKL-0512 | conoserver_framework_VIVII | 6 | 5 | 0 | 3 | 4 | — | 0 | MAWFGL | SKDSE | | SNS | DVTR | |
| TxMEKL-053 precursor | conoserver_framework_VIVII | 6 | 5 | 0 | 3 | 4 | — | 0 | GIWFSR | TKDSE | | SNS | DQTY | |
| TxMEKL-P2 | conoserver_framework_VIVII | 6 | 5 | 0 | 4 | 6 | — | 0 | RGYDAP | SSGAP | | DWWT | SARTNR | |
| TxMKLT1-0111 | conoserver_framework_VIVII | 6 | 6 | 0 | 3 | 4 | — | 0 | KQSGEM | NLLDQN | | DGY | IVFV | |
| TxMKLT1-0141 | conoserver_framework_VIVII | 6 | 6 | 0 | 2 | 4 | — | 0 | LDAGEI | DFFFPT | | GY | ILLF | |
| TxMKLT1-015 | conoserver_framework_VIVII | 6 | 6 | 0 | 3 | 4 | — | 0 | IEQFDP | DMIRHT | | VGV | FLMA | |
| TxMKLT1-0211 | conoserver_framework_VIVII | 6 | 5 | 0 | 3 | 3 | — | 0 | YDGGTS | DSGIQ | | SGW | IFV | |
| TxMKLT1-031 | conoserver_framework_VIVII | 6 | 9 | 0 | 4 | 4 | — | 0 | QEKWDF | PAPFFGSRY | | FGLF | TLFF | |
| TxO1 | conoserver_framework_VIVII | 6 | 6 | 0 | 2 | 4 | — | 0 | LDAGEV | DFFFPT | | GY | ILLF | |
| TxO2 | conoserver_framework_VIVII | 6 | 5 | 0 | 3 | 3 | — | 0 | YDSGTS | NTGNQ | | SGW | IFV | |
| TxO3 | conoserver_framework_VIVII | 6 | 5 | 0 | 3 | 3 | — | 0 | YDGGTS | DSGIQ | | SGW | IFV | |

TABLE 2-continued

| name | class | Loop 1 length | Loop 2 length | Loop 3 length | Loop 4 length | Loop 5 length | Loop 6 length | # 3D structures | Loop 1 | Loop 2 | Loop 3 | Loop 4 | Loop 5 | Loop 6 |
|---|---|---|---|---|---|---|---|---|---|---|---|---|---|---|
| TxO4 | conoserver_frame-workVIVII | 6 | 8 | 0 | 3 | 3 | — | 0 | EPPGNF | GMIKIGPP | | SGW | FFA | |
| TxO5 | conoserver_frame-workVIVII | 6 | 6 | 0 | 3 | 4 | — | 0 | VPYEGP | NWLTQN | | DAT | VVFW | |
| TxO6 | conoserver_frame-workVIVII | 6 | 9 | 0 | 4 | 4 | — | 0 | QEKWDY | PVPFLGSRY | | DGLF | TLFF | |
| TxVII | conoserver_frame-workVIVII | 6 | 6 | 0 | 3 | 3 | — | 1 | KQADEP | DVFSLD | | TGI | LGV | |
| TxVIIA | conoserver_frame-workVIVII | 6 | 5 | 0 | 3 | 4 | — | 0 | GGYSTY | EVDSE | | SDN | VRSY | |
| Vc6.3 | conoserver_frame-workVIVII | 6 | 8 | 0 | 2 | 4 | — | 0 | YGFGEA | LVLYTD | | GY | VLAV | |
| Vc6.4 | conoserver_frame-workVIVII | 6 | 8 | 0 | 3 | 3 | — | 0 | EPPGNF | GMIKVGPP | | SGW | FFA | |
| Vc6.6 | conoserver_frame-workVIVII | 6 | 5 | 0 | 3 | 3 | — | 0 | YDGGTG | DSGNQ | | SGW | IFV | |
| VcVIA | conoserver_frame-workVIVII | 6 | 6 | 0 | 2 | 4 | — | 0 | LSGGEV | DFLFPK | | NY | ILLF | |
| VcVIB | conoserver_frame-workVIVII | 6 | 6 | 0 | 4 | 3 | — | 0 | HEEGQL | DPFLQN | | LGWN | VFV | |
| VcVIC | conoserver_frame-workVIVII | 6 | 6 | 0 | 3 | 4 | — | 0 | IPFLHP | TFFFPD | | NSI | AQFI | |
| VeG52 | conoserver_frame-workVIVII | 6 | 5 | 0 | 3 | 4 | — | 0 | RLWSNG | RKHKE | | SNH | KGIY | |
| ViKr35 | conoserver_frame-workVIVII | 6 | 5 | 0 | 4 | 8 | — | 0 | RRRGQG | TQSTP | | DGLR | DGQRQGG M | |
| ViKr92 | conoserver_frame-workVIVII | 6 | 8 | 0 | 3 | 3 | — | 0 | LDPGYF | GTPFLGAY | | GGI | LIV | |
| Vn6.1 | conoserver_frame-workVIVII | 6 | 5 | 0 | 3 | 4 | — | 0 | SGWSVY | TQHSE | | SGE | TGNY | |
| Vn6.10 | conoserver_frame-workVIVII | 6 | 8 | 0 | 3 | 3 | — | 0 | RPGGMI | GFPKPGPY | | SGW | FVV | |
| Vn6.11 | conoserver_frame-workVIVII | 6 | 8 | 0 | 3 | 3 | — | 0 | EAGGRF | GFPKIGEP | | SGW | FFV | |
| Vn6.12 | conoserver_frame-workVIVII | 6 | 10 | 0 | 3 | 3 | — | 0 | IEDKKY | GILPFANSGV | | SYL | IFV | |
| Vn6.13 | conoserver_frame-workVIVII | 6 | 6 | 0 | 3 | 3 | — | 0 | RQPGEF | FPVVAK | | GGT | LVI | |
| Vn6.14 | conoserver_frame-workVIVII | 6 | 5 | 0 | 3 | 4 | — | 0 | LASGET | WRDTS | | SFS | TNNV | |
| Vn6.15 | conoserver_frame-workVIVII | 6 | 5 | 0 | 3 | 4 | — | 0 | LGSGET | WLDSS | | SFS | TNNV | |
| Vn6.16 | conoserver_frame-workVIVII | 6 | 4 | 0 | 4 | 8 | — | 0 | SGSGYG | KNTP | | AGLT | RGPRQGPl | |
| Vn6.17 | conoserver_frame-workVIVII | 6 | 4 | 0 | 4 | 8 | — | 0 | SGSGYG | KNTP | | DGLT | RGPHQGPI | |
| Vn6.18 | conoserver_frame-workVIVII | 4 | 4 | 0 | 4 | 8 | — | 0 | STAG | KNVP | | EGLV | TGPSQGPV | |
| Vn6.19 | conoserver_frame-workVIVII | 3 | 7 | 0 | 8 | 3 | — | 0 | EEY | EDRDKKT | | GLENGEPF | ATL | |

TABLE 2-continued

| name | class | Loop 1 length | Loop 2 length | Loop 3 length | Loop 4 length | Loop 5 length | Loop 6 length | # 3D structures | Loop 1 | Loop 2 | Loop 3 | Loop 4 | Loop 5 | Loop 6 |
|---|---|---|---|---|---|---|---|---|---|---|---|---|---|---|
| Vn6.2 | conoserver_frame-workVIVII | 6 | 5 | 0 | 3 | 4 | — | 0 | SGWSVM | TQHSD | | SGE | TGSY | |
| Vn6.20 | conoserver_frame-workVIVII | 3 | 6 | 0 | 8 | 3 | — | 0 | KEY | EDRDKT | | GLENGQPD | ANL | |
| Vn6.21 | conoserver_frame-workVIVII | 3 | 6 | 0 | 8 | 3 | — | 0 | YEY | KEQNKT | | GISNGRPI | VGG | |
| Vn6.22 | conoserver_frame-workVIVII | 3 | 6 | 0 | 8 | 3 | — | 0 | EEY | KEQNKT | | GLTNGRPR | VGV | |
| Vn6.3 | conoserver_frame-workVIVII | 6 | 5 | 0 | 3 | 4 | — | 0 | RGWSNG | TTNSD | | SNN | DGTF | |
| Vn6.4 | conoserver_frame-workVIVII | 6 | 5 | 0 | 3 | 3 | — | 0 | TGWLDG | TSPAE | | TAV | DAT | |
| Vn6.5 | conoserver_frame-workVIVII | 6 | 5 | 0 | 3 | 6 | — | 0 | RTWYAP | NFPSQ | | SEV | SSKTGR | |
| Vn6.6 | conoserver_frame-workVIVII | 6 | 7 | 0 | 4 | 3 | — | 0 | VGLSSY | GPWNNPP | | SWYT | DYY | |
| Vn6.7 | conoserver_frame-workVIVII | 6 | 7 | 0 | 4 | 3 | — | 0 | VGWSSY | GPWNNPP | | SWYT | DYY | |
| Vn6.8 | conoserver_frame-workVIVII | 6 | 8 | 0 | 3 | 3 | — | 0 | VAGGHF | GFPKIGGP | | SGW | FFV | |
| Vn6.9 | conoserver_frame-workVIVII | 6 | 8 | 0 | 3 | 3 | — | 0 | AAGGQF | GFPKIGGP | | SGW | LGV | |
| VxVIA | conoserver_frame-workVIVII | 6 | 5 | 0 | 3 | 6 | — | 0 | NNRGGG | SQHPH | | SGT | NKTFGV | |
| VxVIB | conoserver_frame-workVIVII | 6 | 6 | 0 | 3 | 8 | — | 0 | TDDSQF | DPNDHD | | SGE | IDEGGRGV | |
| conotoxin-GS | conoserver_frame-workVIVII | 6 | 3 | 0 | 4 | 7 | — | 1 | SGRGSR | PPQ | | MGLR | GRGNPQK | |
| ArXIA | conoserver_frame-workXI | 6 | 5 | 0 | 3 | 5 | — | 0 | SRRGHR | IRDSQ | | GGM | CQGNR | |
| Au11.6 | conoserver_frame-workXI | 6 | 5 | 0 | 3 | 5 | — | 0 | SWPGQE | EHDSD | | GSF | CVGRR | |
| BeTX | conoserver_frame-workXI | 6 | 5 | 0 | 3 | 4 | — | 0 | RAEGTY | ENDSQ | | LNE | CWGG | |
| Bt11.1 | conoserver_frame-workXI | 6 | 5 | 0 | 3 | 5 | — | 0 | LSLGQR | ERHSN | | GYL | CFYDK | |
| Bt11.4 | conoserver_frame-workXI | 6 | 5 | 0 | 3 | 5 | — | 0 | LSLGQR | GRHSN | | GYL | CFYDK | |
| Cp1.1 | conoserver_frame-workXI | 6 | 5 | 0 | 3 | 4 | — | 0 | FPPGVY | TRHLP | | RGR | CSGW | |
| Em11.10 | conoserver_frame-workXI | 6 | 5 | 0 | 3 | 3 | — | 0 | FPPGIY | TPYLP | | WGI | CGT | |
| Ep11.1 | conoserver_frame-workXI | 6 | 5 | 0 | 3 | 5 | — | 0 | SGIGQG | GQDSN | | GDM | CYGQI | |
| Ep11.12 | conoserver_frame-workXI | 6 | 5 | 0 | 3 | 4 | — | 0 | LSEGSP | SMSGS | | HKS | CRST | |
| Fi11.11 | conoserver_frame-workXI | 6 | 5 | 0 | 3 | 4 | — | 0 | HHEGLP | TSGDG | | GME | CGGV | |
| Fi11.1a | conoserver_frame-workXI | 6 | 5 | 0 | 1 | 5 | — | 0 | GKDGRA | DYHAD | | N | CLGGI | |

TABLE 2-continued

| name | class | Loop 1 length | Loop 2 length | Loop 3 length | Loop 4 length | Loop 5 length | Loop 6 length | # 3D structures | Loop 1 | Loop 2 | Loop 3 | Loop 4 | Loop 5 | Loop 6 |
|---|---|---|---|---|---|---|---|---|---|---|---|---|---|---|
| Fi11.6 | conoserver_framework XI | 6 | 5 | 0 | 1 | 5 | — | 0 | KKDRKP | SYHAD | | N | CLSGI | |
| Fi11.8 | conoserver_framework XI | 6 | 5 | 0 | 1 | 5 | — | 0 | KADEEP | EYHAD | | N | CLSGI | |
| Im11.1 | conoserver_framework XI | 6 | 5 | 0 | 3 | 4 | — | 0 | LRDGQS | GYDSD | | RYS | CWGY | |
| Im11.2 | conoserver_framework XI | 6 | 5 | 0 | 3 | 4 | — | 0 | RLEGSS | RRSYQ | | HKS | CIRE | |
| Im11.3 | conoserver_framework XI | 6 | 5 | 0 | 3 | 4 | — | 0 | TSEGYS | SSDSN | | KNV | CWNV | |
| L11.5 | conoserver_framework XI | 6 | 5 | 0 | 3 | 5 | — | 0 | SGSGEG | DYHSE | | GER | CIESM | |
| Mi11.1a | conoserver_framework XI | 6 | 5 | 0 | 1 | 5 | — | 0 | GKDGRQ | RNHAD | | N | CPIGT | |
| Mi11.2 | conoserver_framework XI | 6 | 5 | 0 | 3 | 5 | — | 0 | SNKGQQ | GDDSD | | WHL | CVNNK | |
| Mi11.5 | conoserver_framework XI | 6 | 5 | 0 | 1 | 5 | — | 0 | GKDGRK | GYHAD | | N | CLSGI | |
| Mi11.1 | conoserver_framework XI | 6 | 5 | 0 | 3 | 4 | — | 0 | FPPGTF | SRYLP | | SGR | CSGW | |
| R11.1 | conoserver_framework XI | 6 | 5 | 0 | 1 | 5 | — | 0 | GKDGRK | GYHAD | | N | CLSGI | |
| R11.10 | conoserver_framework XI | 6 | 5 | 0 | 1 | 5 | — | 0 | GKDGRK | GYHAD | | N | CLSGI | |
| R11.11 | conoserver_framework XI | 6 | 5 | 0 | 1 | 5 | — | 0 | GKDGRA | DYHAD | | N | CLGGI | |
| R11.12 | conoserver_framework XI | 6 | 5 | 0 | 1 | 5 | — | 0 | GKDRRK | GYHAD | | N | CLSGI | |
| R11.13 | conoserver_framework XI | 6 | 5 | 0 | 1 | 5 | — | 0 | GKDGRK | GYHAD | | N | CLSGI | |
| R11.15 | conoserver_framework XI | 6 | 5 | 0 | 1 | 5 | — | 0 | GKDGRK | GYHTH | | N | CLSGI | |
| R11.16 | conoserver_framework XI | 6 | 5 | 0 | 1 | 5 | — | 0 | GKDGRK | SYHAD | | N | CLSGI | |
| R11.17 | conoserver_framework XI | 6 | 5 | 0 | 1 | 5 | — | 0 | KANGKP | RNHAD | | N | CLSGI | |
| R11.18 | conoserver_framework XI | 6 | 5 | 0 | 1 | 5 | — | 0 | GKDGRQ | RNHAD | | N | CPFGT | |
| R11.2 | conoserver_framework XI | 6 | 5 | 0 | 1 | 5 | — | 0 | GKDGRQ | RNHAD | | N | CPIGT | |
| R11.3 | conoserver_framework XI | 6 | 5 | 0 | 3 | 5 | — | 0 | WVGRVH | TYHKD | | PSV | CFKGR | |
| R11.5 | conoserver_framework XI | 6 | 5 | 0 | 1 | 5 | — | 0 | GKDGRQ | RNHAD | | N | CPIGT | |
| R11.7 | conoserver_framework XI | 6 | 5 | 0 | 1 | 5 | — | 0 | KADEKP | EYHSD | | N | CLSGI | |
| RXIA | conoserver_framework XI | 6 | 5 | 0 | 1 | 5 | — | 1 | KADEKP | EYHAD | | N | CLSGI | |
| RXIB | conoserver_framework XI | 6 | 5 | 0 | 1 | 5 | — | 0 | KANGKP | SYHAD | | N | CLSGI | |

TABLE 2-continued

| name | class | Loop 1 length | Loop 2 length | Loop 3 length | Loop 4 length | Loop 5 length | Loop 6 length | # 3D structures | Loop 1 | Loop 2 | Loop 3 | Loop 4 | Loop 5 | Loop 6 |
|---|---|---|---|---|---|---|---|---|---|---|---|---|---|---|
| RXIC | conoserver_frameworkXI | 6 | 5 | 0 | 1 | 5 | — | 0 | KADEKP | KYHAD | | N | CLGGI | |
| RXID | conoserver_frameworkXI | 6 | 5 | 0 | 1 | 5 | — | 0 | KKDRKP | SYHAD | | N | CLSGI | |
| RXIE | conoserver_frameworkXI | 6 | 5 | 0 | 3 | 5 | — | 0 | KTNKMS | SLHEE | | RFR | CFHGK | |
| RgXIA | conoserver_frameworkXI | 6 | 5 | 0 | 5 | 8 | — | 0 | QAYGES | SAWR | | DPNAV | CQYPEDAV | |
| S11.2a | conoserver_frameworkXI | 6 | 5 | 0 | 1 | 5 | — | 0 | KKDRKP | SYQAD | | N | CPIGT | |
| S11.3 | conoserver_frameworkXI | 6 | 5 | 0 | 3 | 4 | — | 0 | VPPSRY | TRHRP | | RGT | CSGL | |
| SiXIA | conoserver_frameworkXI | 6 | 5 | 0 | 3 | 4 | — | 0 | RTEGMS | EENQQ | | WRS | CRGE | |
| Sx11.2 | conoserver_frameworkXI | 6 | 5 | 0 | 3 | 4 | — | 0 | RAEGTY | ENDSQ | | LNE | CWGG | |
| TxXI | conoserver_frameworkXI | 6 | 5 | 0 | 3 | 4 | — | 0 | IPEGSS | SSSGS | | HKS | CRWT | |
| ViTx | conoserver_frameworkXI | 6 | 5 | 0 | 3 | 3 | — | 0 | FPPGIY | TPYLP | | WGI | CGT | |
| Vx11.1 | conoserver_frameworkXI | 6 | 5 | 0 | 3 | 3 | — | 0 | FPPGIY | TPYLP | | WGI | CDT | |
| Vx11.2 | conoserver_frameworkXI | 6 | 5 | 0 | 3 | 3 | — | 0 | FPPGIY | TPYLP | | WGI | CDT | |
| AVR9_CLAFU | fungi1 | 3 | 5 | 3 | 2 | 6 | — | 0 | NSS | TRAFD | LGQ | GR | DFHKLQ | |
| U499_ASPCL | fungi1 | 3 | 5 | 3 | 2 | 6 | — | 0 | GQL | FNNKD | GGP | PK | NTKEGV | |
| U499_ASPTN | fungi1 | 3 | 5 | 3 | 2 | 4 | — | 0 | GQV | TGKND | SGE | NK | VNFV | |
| U499_NEOFI | fungi1 | 3 | 5 | 3 | 2 | 6 | — | 0 | GQV | LNKTG | GGK | PK | DMRSLT | |
| A6RPC6_BOTFB | fungi2 | 6 | 6 | 0 | 4 | 12 | — | 0 | IAKGEV | HQTGET | | DGFK | ALAHGGKA DVGF | |
| A6SKI6_BOTFB | fungi2 | 6 | 6 | 0 | 4 | 4 | — | 0 | LPQGES | MMQHDK | | HGLM | NSGE | |
| A7EBW4_SCLS1 | fungi2 | 6 | 6 | 0 | 4 | 12 | — | 0 | IKNGEV | HLTGES | | DGFK | ALAHGGKA NVGY | |
| B0CWT3_LACBS | fungi2 | 6 | 7 | 0 | 4 | 9 | — | 0 | LGRDHD | DPDGREL | | RGLI | APFGPFGGS | |
| B0DJS7_LACBS | fungi2 | 6 | 5 | 0 | 3 | 10 | — | 0 | VTKGKI | SKDSD | | KKV | FPVPFGNGG V | |
| B0DQK7_LACBS | fungi2 | 6 | 5 | 0 | 3 | 12 | — | 0 | FIALTP | AADKD | | SGL | KISLSAVGL GLR | |
| B0DQL1_LACBS | fungi2 | 6 | 5 | 0 | 3 | 16 | — | 0 | LMDGSY | MSNSD | | SEL | VVFESSPLS RTVFVDW | |
| B0DQL3_LACBS | fungi2 | 6 | 5 | 0 | 3 | 11 | — | 0 | YVRGDY | QTDSD | | GRI | YPFAPEMV YGF | |
| B0DU64_LACBS | fungi2 | 6 | 5 | 0 | 3 | 11 | — | 0 | FGLGSP | SFNSN | | SGY | LIIPPTIVLG F | |
| B0DVV7_LACBS | fungi2 | 6 | 5 | 0 | 3 | 11 | — | 0 | FALGTL | SFDSN | | SGH | NSIPLIFVLG F | |
| U499_CHAGB | fungi2 | 6 | 5 | 0 | 4 | 8 | — | 0 | HSILTS | RVDTD | | AGLK | GIFDEDAL | |
| U499_NEUCR | fungi2 | 6 | 5 | 0 | 4 | 8 | — | 0 | RAILTT | RVTSD | | SGMK | VSADGESV | |

TABLE 2-continued

| name | class | Loop 1 length | Loop 2 length | Loop 3 length | Loop 4 length | Loop 5 length | Loop 6 length | # 3D structures | Loop 1 | Loop 2 | Loop 3 | Loop 4 | Loop 5 | Loop 6 |
|---|---|---|---|---|---|---|---|---|---|---|---|---|---|---|
| A0MK33 | grow_factors | 28 | 3 | 31 | 31 | 1 | — | 0 | RRHSLYVDFSDV GWNDWIVAPPG YHAFY | QGE | PFPLADHLNSTNH AIVQTLVNSVNTN IPKAC | VPTDLSPVSLLYLD EYERVILKNYQDM VVEG | G | |
| A0MK34 | grow_factors | 28 | 3 | 31 | 31 | 1 | — | 0 | RRHPLYVDFSDV GWNEWIVAPPG YHAFY | NGE | PFPLSDHLNSTNH AIVQTLVNSVNSN IPRAC | VPTELSPISLLYLDE YEKVVLKNYQDM VVEG | G | |
| A0MK35 | grow_factors | 28 | 3 | 31 | 31 | 1 | — | 0 | RRHALYVDFSDV GWNDWIVAPPG YQAYY | HGE | PFPLADHLNSTNH AIVQTLVNSVNSN IPKAC | VPTELSAISMLYLD ETDRVVLKNYQEM VVEG | G | |
| A0MK36 | grow_factors | 28 | 3 | 31 | 31 | 1 | — | 0 | KRHVLYVDFSDV GWNEWIVAPPG YDAFY | HGE | PFPLPDHLNATNH AVVQTLVNSVNS NIPKAC | VPTELSPISLLYLDE FEKVTLKNYQDM VVDG | G | |
| A0MK37 | grow_factors | 28 | 3 | 31 | 31 | 1 | — | 0 | RRHTLYVDFSDV GWNDWIVAPPG YQAYY | HGE | PFPLADHLNSTNH AIVQTLVNSVNN NIPKAC | VPTELSAISMLYLD EYDKVVLKNYQE MVVEG | G | |
| A0SLB5 | grow_factors | 28 | 3 | 32 | 31 | 1 | — | 0 | RRHPLYVDFSDV HWNDWIVAPAG YQAYY | HGE | PFPLAEHLNTTNH AIVQTLVNSVNPA LVPKAC | VPTELSAISMLYLD EYEKVVLKNYQD MVVEG | G | |
| A0SLB6 | grow_factors | 28 | 3 | 32 | 31 | 1 | — | 0 | QRHRLFVSFRDV GWEDWILAPMG YQAYY | DGE | PFPLGERLNGTNH AIIQTLVNSIDSRA VPKVC | APTKLSGISMLYFD NNENVVLRQYED MVVEA | G | |
| A1KXV9 | grow_factors | 28 | 3 | 31 | 31 | 1 | — | 0 | KRHALYVDFSDV GWNEWIVAPPG YHAFY | HGE | PFPLADHLNSTNH AIVQTLVNSVNSN IPRAC | VPTDLSPISLLYLD EYEKVILKNYQDM VVEG | G | |
| A1XP54 | grow_factors | 30 | 3 | 6 | 33 | 1 | — | 0 | QVREILVDIFQEY PEEVEYIFKPSCV PLMR | AGC | NDESLE | VSTESYNITMQIMK IKPHISQHIMDMSF QQHSH | E | |
| A2A2V4 | grow_factors | 30 | 3 | 6 | 33 | 1 | — | 1 | HPIETLVDIFQEY PDEIEYIFKPSCV PLMR | GGC | NDEGLE | VPTEESNITMQIMR IKPHQGQHIGEMSF LQHNK | E | |
| A2AII0 | grow_factors | 28 | 3 | 32 | 31 | 1 | — | 0 | SRKPLHVNFKEL GWDDWIIAPLEY EAYH | EGV | DFPLRSHLEPTNH AIIQTLMNSMDPG STPPSC | VPTKLTPISILYIDA GNNVYKQYEDM VVES | G | |
| A2ARK2 | grow_factors | 28 | 3 | 32 | 31 | 1 | — | 0 | SRKALHVNFKD MGWDDWIIAPLE YEAFH | EGL | EFPLRSHLEPTNH AVIQTLMNSMDP ESTPPTC | VPTRLSPISILFIDSA NNVVYKQYEDMV VES | G | |
| A2AUJ3 | grow_factors | 28 | 3 | 32 | 31 | 1 | — | 0 | KKHELYVSFRDL GWQDWIIAPEGY AAYY | EGE | AFPLNSYMNATIN HAIVQTLVHFINP DTVPKPC | APTQLNAISVLYFD DSSNVILKKYRNM VVRA | G | |
| A4UY01 | grow_factors | 28 | 3 | 31 | 31 | 1 | — | 0 | RRHALYVDFSDV GWNDWIVAPPG YQAYY | HGE | PFPLADHLNSTNH AIVQTLVNSVNN NIPKAC | VPTELSAISMLYLD EHDKVVLKNYQE MVVEG | G | |
| A4VCG6 | grow_factors | 30 | 3 | 6 | 33 | 1 | — | 0 | RPREMLVEIQQE YPDDTEHIFIPSC WLTR | AGC | NDEMME | TPTVTYNITLEIKRL KPLRHQGDIFMSFA EHSE | Q | |
| A5GFN1 | grow_factors | 28 | 3 | 32 | 31 | 1 | — | 0 | KKHELYVSFRDL GWQDWIIAPEGY AAYY | EGE | AFPLNSYMNATIN HAIVQTLVHFINP ETVPKPC | APTQLNAISVLYFD DSSNVILKKYRNM VVRA | G | |

TABLE 2-continued

| name | class | Loop 1 length | Loop 2 length | Loop 3 length | Loop 4 length | Loop 5 length | Loop 6 length | # 3D structures | Loop 1 | Loop 2 | Loop 3 | Loop 4 | Loop 5 | Loop 6 |
|---|---|---|---|---|---|---|---|---|---|---|---|---|---|---|
| A5GFN2 | grow_factors | 28 | 3 | 32 | 31 | 1 | — | 0 | KKHELYVSFRDL GWQDWIIAPEGY AAYY | EGE | AFPLNSYMNATN HAIVQTLVHFINP ETVPKPC | APTQLNAISVLYFD DSSNVILKKYRNM VVRA | G | |
| A5HMF8 | grow_factors | 28 | 3 | 31 | 31 | 1 | — | 0 | RRHALYVDFSDV GWNDWIVAPPG YQAFY | HGD | PFPLADHLNSTNH AIVQTLVNSVNSS IPKAC | VPTELSAISMLYLD EYDKVVLKNYQE MVVEG | G | |
| A5HMF9 | grow_factors | 28 | 3 | 31 | 31 | 1 | — | 0 | RRHALYVDFSDV GWNDWIVAPPG YQAFY | HGD | PFPLADHLNSTNH AIVQTLVNSVNSS IPKAC | VPTELSAISMLYLD EYDKVVLKNYQE MVVEG | G | |
| A5JL80 | grow_factors | 30 | 3 | 6 | 33 | 1 | — | 0 | QPRELLVDILQE YPEEVEHIFIPSC WLKR | AGC | NDEMLQ | TPTETYNITMEIKRI KPQRQQNDIFMSFT EHSA | E | |
| A5PII9 | grow_factors | 28 | 3 | 31 | 31 | 1 | — | 0 | KRHPLYVDFSDV GWNDWIVAPPG YHAFY | HGE | PFPLADHLNSTNH AIVQTLVNSVNSK IPKAC | VPTELSAISMLYLD ENEKVVLKNYQD MVVEG | G | |
| A6N998 | grow_factors | 28 | 3 | 31 | 31 | 1 | — | 0 | RRHSLYVDFSDV GWNDWIVAPPG YQAFY | HGD | PFPLADHLNSTNH AIVQTLVNSVNSS IPKAC | VPTELSAISMLYLD EYDKVVLKNYQE MVVEG | G | |
| A7L634 | grow_factors | 28 | 3 | 31 | 31 | 1 | — | 0 | KRHPLYVDFSDV GWNDWIVAPPG YHAFY | HGE | PFPLADHLNSTNH AIVQTLVNSVNSK IPKAC | VPTELSAISMLYLD ENEKVVLKNYQD MVVEG | G | |
| A7LCK8 | grow_factors | 28 | 3 | 32 | 31 | 1 | — | 0 | KKHELYVSFRDL GWQDWIIAPEGY AAYY | EGE | AFPLNSYMNATN HAIVQTLVHFIDP DTVPKPC | APTQLNAISVLYFD DSSNVILKKYRNM VVRA | G | |
| A7LJT9 | grow_factors | 28 | 3 | 31 | 31 | 1 | — | 0 | RRHSLYVDFSDV GWNDWIVAPPG YQAFY | HGD | PFPLADHLNSTNH AIVQTLVNSVNSS IPKAC | VPTELSAISMLYLD EYDKVVLKNYQE MVVEG | G | |
| A7RQJ0 | grow_factors | 28 | 3 | 32 | 31 | 1 | — | 0 | QRQALHVSFRKL RWQDWVIAPEG YSAFY | SGE | SFPLNANMNATN HAIVQTLVHFLMN PKTVPKPC | APTELSPISVLYFD QDNNVVLKKYNK MVVKA | G | |
| A7SAY4 | grow_factors | 28 | 3 | 31 | 32 | 1 | — | 0 | QRHPLYVDFTDV GWNDWIVAPPG YHAFY | TGV | PYPIAKHLNATNH AIVQTIMNTVDSN VPNAC | IPTTLNPISILSLNEF DKVVLKNYKDMVI EG | G | |
| A7SZ10 | grow_factors | 28 | 3 | 32 | 32 | 1 | — | 0 | RRKRMYVDFRL LGWSDWIIAPQG YDAYL | EGE | KYPIDNYLRPTNH ATVQTIVNSLDPSI APKAC | TPNELSPISIILYTED GSNNVVYKNYKD MVVER | G | |
| A8E7N9 | grow_factors | 28 | 3 | 32 | 31 | 1 | — | 0 | SKKPLHVNFREL GWDDWVIAPLD YEAYH | EGM | DFPLRSHLEPTNH AIIQTLMNSMNPS NMPPSC | VPSKLSPISILYIDA GNNVVYKQYEDM VVES | G | |
| A8K571 | grow_factors | 28 | 3 | 32 | 31 | 1 | — | 0 | KKHELYVSFRDL GWQDWIIAPEGY AAYY | EGE | AFPLNSYMNATN HAIVQTLVHFINP ETVPKPC | APTQLNAISVLYFD DSSNVILKKYRNM VVRA | G | |
| A8K694 | grow_factors | 28 | 3 | 32 | 31 | 1 | — | 0 | KKHELYVSFRDL GWQDWIIAPEGY AAFY | DGE | SFPLNAHMNATN HAIVQTLVHLMFP DHVPKPC | APTKLNAISVLYFD DSSNVILKKYRNM VVRS | G | |
| A8S3P5 | grow_factors | 28 | 3 | 32 | 31 | 1 | — | 0 | KKHELYVSFRDL GWQDWIIAPEGY AAYY | EGE | AFPLNSYMNATN HAIVQTLVHFINP ETVPKPC | APTQLNAISVLYFD DSSNVILKKYRNM VVRA | G | |

TABLE 2-continued

| name | class | Loop 1 length | Loop 2 length | Loop 3 length | Loop 4 length | Loop 5 length | Loop 6 length | # 3D structures | Loop 1 | Loop 2 | Loop 3 | Loop 4 | Loop 5 | Loop 6 |
|---|---|---|---|---|---|---|---|---|---|---|---|---|---|---|
| A8VTF8 | grow_factors | 28 | 3 | 31 | 31 | 1 | — | 0 | RRHSLYVDFSDV GWNDWIVAPPG YQAFY | HGD | PFPLADHLNSTNH AIVQTLVNSVNSS IPKAC | VPTELSAISMLYLD EYDKVALKNYQE MVVEG | G | |
| A9ULK0 | grow_factors | 28 | 3 | 31 | 31 | 1 | — | 0 | RRHSLYVDFSDV GWNDWIVAPPG YQAFY | HGD | PFPLADHLNSTNH AIVQTLVNSVNSS IPKAC | VPTDLSAISMLYLD EYDKVVLKNYQE MVVEG | G | |
| B0BMQ3 | grow_factors | 30 | 3 | 6 | 33 | 1 | — | 0 | QVREILVDIFQEY PDEVEYIFKPSCV PLMR | AGC | NDESLE | VPTESYNITMQIMK IKPHISQHIMDMSF QQHSQ | E | |
| B0CM38 | grow_factors | 28 | 3 | 31 | 31 | 1 | — | 0 | RRHSLYVDFSDV GWNOWIVAPPG YQAFY | HGD | PFPLADHLNSTNH AIVQTLVNSVNSS IPKAC | VPTELSAISMLYLD EYDKVVLKNYQE MVVEG | G | |
| B0CM78 | grow_factors | 28 | 3 | 32 | 31 | 1 | — | 0 | SRKALHVNFKD MGWDDWIIAPLE YEAFH | EGL | EFPLRSHLEPTNH AVIQTLMNSMDP ESTPPTC | VPTRLSPISILFIDSA NNVVYKQYEDMV VES | G | |
| B0FN90 | grow_factors | 30 | 3 | 6 | 33 | 1 | — | 0 | RPIETLVDIFQEY PDEIEFIFKPSCVP LMR | GGC | NDESLE | VPTEEFNITMQIMR IKPHQNQHIGEMSF LQHNK | E | |
| B0KWL9 | grow_factors | 28 | 3 | 32 | 31 | 1 | — | 1 | SRKALHVNFKD MGWDDWIIAPLE YEAFH | EGL | EFPLRSHLEPTNH AVIQTLMNSMDP ESTPPTC | VPTRLSPISILFIDSA NNVVYKQYEDMV VES | G | |
| B0VXV3 | grow_factors | 30 | 3 | 6 | 34 | 1 | — | 0 | QTREMLVSILDE HPDEVAHLFRPS CVTVLR | GGC | TDESLM | TATGKRSVGREIM RVDPRKETSKIQV MQFTEHTK | E | |
| B0VXV4 | grow_factors | 30 | 3 | 6 | 34 | 1 | — | 0 | QTREMLVSILDE HPDEVAHLFRPS CVTVLR | GGC | TDESLM | TATGKRSVGREIM RVDPRKETSKIEV MQFTEHTE | E | |
| B0WCI2 | grow_factors | 28 | 3 | 32 | 31 | 1 | — | 0 | QRRPLYVDFSDV GWSDWIAPPG YEAFY | QGD | QFPIADHLNTTNH AIVQTLVNSISPSY APKAC | VPTQLSSISMLYLN EQNKVVLKNYQD MTVVG | G | |
| B1AKZ9 | grow_factors | 28 | 3 | 32 | 31 | 1 | — | 0 | KKHELYVSFRDL GWQDWIIAPEGY AAYY | EGE | AFPLNSYMNATN HAIVQTLVHFINP ETVPKPC | APTQLNAISVLYFD DSSNVILKKYRNM VVRA | G | |
| B1MTM2 | grow_factors | 28 | 3 | 32 | 31 | 1 | — | 0 | SRKALHVNFKD MGWDDWIIAPLE YEAFH | EGL | EFPLRSHLEPTNH AVIQTLMNSMDP ESTPPTC | VPTRLSPISILFIDSA NNVVYKQYEDMV VES | G | |
| B1P8C3 | grow_factors | 28 | 3 | 31 | 31 | 1 | — | 0 | RRHPLYVDFSDV GWNDWIVAPPG YHAFY | HGD | PFPLADHMNSTN HAIVQTLVNSVN ANIPKAC | VPTELSAISMLYLD ENEKVVLKNYQD MVVEG | G | |
| B2C4I5 | grow_factors | 30 | 3 | 6 | 33 | 1 | — | 0 | RPIETLVDIFQEY PDEIEYIFKPSCV PLMR | AGC | NDESLE | VPTEEFNITMQIMR IKPHQGQHIGEMSF LQHNK | E | |
| B2C4I6 | grow_factors | 30 | 3 | 6 | 33 | 1 | — | 0 | RPIETLVDIFQEY PDEIEYIFKPSCV PLMR | AGC | NDESLE | VPTEEFNITMQIMR IKPHQGQHIGEMSF LQHNK | E | |
| B2KI82 | grow_factors | 28 | 3 | 31 | 31 | 1 | — | 0 | RRHSLYVDFSDV GWNDWIVAPPG YQAFY | HGD | PFPLADHLNSTNH AIVQTLVNSVNSS IPKAC | VPTELSAISMLYLD EYDKVVLKNYQE MVVEG | G | |

TABLE 2-continued

| name | class | Loop 1 length | Loop 2 length | Loop 3 length | Loop 4 length | Loop 5 length | Loop 6 length | # 3D structures | Loop 1 | Loop 2 | Loop 3 | Loop 4 | Loop 5 | Loop 6 |
|---|---|---|---|---|---|---|---|---|---|---|---|---|---|---|
| B2KIC7 | grow_factors | 28 | 3 | 32 | 31 | 1 | — | 0 | SRKALHVNFKD MGWDDWIIAPLE YEAFH | EGL | EFPLRSHLEPTNH AVIQTLMNSMDP ESTPPTC | VPTRLSPISILFIDSA NNVVYKQYEDMV VES | G | |
| B2KL65 | grow_factors | 28 | 3 | 32 | 31 | 1 | — | 0 | RKHELYVSFQDL GWQDWIIAPKGY AANY | DGE | SFPLNAHMNATN HAIVQTLVHLMN PEYVPKPC | APTKLNAISVLYFD DNSNVILKKYRNM VVRA | G | |
| B2KL66 | grow_factors | 28 | 3 | 32 | 31 | 1 | — | 0 | RKHELYVSFQDL GWQDWIIAPKGY AANY | DGE | SFPLNAHMNATN HAIVQTLVHLMN PEYVPKPC | APTKLNAISVLYFD DNSNVILKKYRNM VVRA | G | |
| B2RRV6 | grow_factors | 28 | 3 | 32 | 31 | 1 | — | 0 | KKHELYVSFQDL GWQDWIIAPKGY AANY | DGE | SFPLNAHMNATN HAIVQTLVHLMN PEYVPKPC | APTKLNAISVLYFD DNSNVILKKYRNM VVRA | G | |
| B2ZP8 | grow_factors | 28 | 3 | 32 | 31 | 1 | — | 0 | KKHELYVSFRDL GWQDWIIAPEGY AAYY | EGE | AFPLNSYMNATN HAIVQTLVHFINP ETVPKPC | APTQLNAISVLYFD DSSNVILKKYRNM VVRA | G | |
| B3D186 | grow_factors | 28 | 3 | 31 | 31 | 1 | — | 0 | RRHSLYVDFSDV GWNDWIVAPPG YHAFY | QGE | PFPLADIHLNSTNH AIVQTLVNSVSN IPRAC | VPTDLSPVSLLYLD EYERVILKNYQDM VVEG | G | |
| B3D143 | grow_factors | 28 | 3 | 32 | 31 | 1 | — | 0 | SKKPLHVNFREL GWDDWVIAPLD YEAYH | EGM | DFPLRSHLEPTNH AIIQTLMNSMNPS NMPPSC | VPSKLSPISILYIDA GNNVVYKQYEDM VVES | G | |
| B3FNR0 | grow_factors | 28 | 3 | 32 | 31 | 1 | — | 0 | RRHELYVDFSDV HWNDWIVAPAG YQAYY | RGE | PFPLAEHLNTTNH AIVQTLVNSVNPA LVPKAC | VPTELSAISMLYLD EYEKVVLKNYQD MVVEG | G | |
| B3NA13 | grow_factors | 28 | 3 | 32 | 31 | 1 | — | 0 | RRHSLYVDFSDV GWDDWIVAPLG YDAYY | HGK | PFPLADHFNSTNH AVVQTLVNNMNP GKVPKAC | VPTQLDSVAMLYL NDQSTVVLKNYQE MTVVG | G | |
| B3RF16 | grow_factors | 28 | 3 | 31 | 31 | 1 | — | 0 | RRHSLYVDFSDV GWNDWIVAPPG YQAFY | HGD | PFPLADHLNSTNH AIVQTLVNSVSS IPKAC | VPTELSAISMLYLD EYDKVVLKNYQE MVVEG | G | |
| B3RF47 | grow_factors | 28 | 3 | 32 | 31 | 1 | — | 0 | SRKALHVNFKD MGWDDWIIAPLE YEAFH | EGL | EFPLRSHLEPTNH AVIQTLMNSMDP ESTPPTC | VPTRLSPISILFIDSA NNVVYKQYEDMV VES | G | |
| B3Y026 | grow_factors | 28 | 3 | 32 | 31 | 1 | — | 0 | RRKELNVDFKAV GWNDWIFAPPG YNAYY | DGS | HWPYDDHMNVT NHAIVQDLVNSID PRAAPKC | VPTELSSLSLLYTD EHGTVVLKVYQD MVVEG | G | |
| B4DUF7 | grow_factors | 28 | 3 | 32 | 31 | 1 | — | 0 | RKHELYVSFQDL GWQDWIIAPKGY AANY | DGE | SFPLNAHMNATN HAIVQTLVHLMN PEYVPKPC | APTKLNAISVLYFD DNSNVILKKYRNM VVRA | G | |
| B4JAU3 | grow_factors | 28 | 3 | 32 | 31 | 1 | — | 0 | RRHSLYVDFQDV GWSDWIVAPPG YDAFY | HGK | PFPLADHLNSTNH AVVQTLVNNLNP GKVPKAC | VPTQLEGISMLYLN DQRTVLKNYPD MTVVG | G | |
| B4KGU4 | grow_factors | 28 | 3 | 32 | 31 | 1 | — | 0 | RRHSLYVDFQDV GWSDWIVAPPG YDAYY | HGK | PFPLADHLNSTNH AVVQTLVNNINP GKVPKAC | VPTQLEGISMLYLN DQRTVLKNYQD MITVVG | G | |
| B4LUE0 | grow_factors | 28 | 3 | 32 | 31 | 1 | — | 0 | RRHSLYVDFQDV GWSDWIVAPPG YDAYY | HGK | QFPLADIHLNSTNH AVVQTLVNNLNP GKVPKAC | VPTQLEGISMLYLN DQRTVLKNYQD MITVVG | G | |

TABLE 2-continued

| name | class | Loop 1 length | Loop 2 length | Loop 3 length | Loop 4 length | Loop 5 length | Loop 6 length | # 3D structures | Loop 1 | Loop 2 | Loop 3 | Loop 4 | Loop 5 | Loop 6 |
|---|---|---|---|---|---|---|---|---|---|---|---|---|---|---|
| B4MU02 | grow_factors | 28 | 3 | 32 | 31 | 1 | — | 0 | RRHSLYVDFADV GWSDWIVAPPG YDAF | HGK | PFPLADHLNSTNH AVVQTLVNNIDP GKVPKAC | VPTQLEGISMLYLN DQSTVVLKNYQD MITVVG | G | |
| B4NWQ1 | grow_factors | 28 | 3 | 32 | 31 | 1 | — | 0 | RRHSLYVDFSDV GWDDWIVAPLG YDAYY | HGK | PFPLADHFNSTNH AVVQTLVNNMNP GKVPKAC | VPTQLDSVAMLYL NDQSTVVLKNYQE MITVVG | G | |
| B4Q848 | grow_factors | 28 | 3 | 32 | 31 | 1 | — | 0 | RRHSLYVDFSDV GWDDWIVAPLG YDAYY | HGK | PFPLADHFNSTNH AVVQTLVNNMNP GKVPKAC | VPTQLDSVAMLYL NDQSTWLKNYQE MITVVG | G | |
| B4YYD6 | grow_factors | 30 | 3 | 6 | 33 | 1 | — | 0 | RPIETLVDIFQEY PDEIEYIFKPSCV PLMR | GGC | NDEGLE | VPTEEFNITMQIMR IKPHQGQHIGEMSF LQHNK | E | |
| B5BNX6 | grow_factors | 28 | 3 | 32 | 31 | 1 | — | 0 | SKKPLHVNFKD MGWDDWIIAPLE YEAYH | EGL | EFPLRSHLEPTNH AVIQTLMNSMDP ETTPPTC | VPTRLSPISILYTDS ANNVVYKQYEDM VVES | G | |
| B5BU86 | grow_factors | 30 | 3 | 6 | 33 | 1 | — | 1 | HPIETLVDIFQEY PDEIEYIFKPSCV PLMR | GGC | NDEGLE | VPTEESNITMQIMR IKPHQGQHIGEMSF LQHNK | E | |
| B5DEK7 | grow_factors | 30 | 3 | 6 | 33 | 1 | — | 0 | RPIETLVDIFQYP DEIEYIFKPSCVP LMR | AGC | NDEALE | VPTSESSNVTMQIM RIKPHQSQHIGEMS FLQHSR | E | |
| B5FW32 | grow_factors | 28 | 3 | 31 | 31 | 1 | — | 0 | RRHSLYVDFSDV GWNDWIVAPPG YQAF | HGD | PFPLADHLNSTNH AIVQTLVNSVNSS IPKAC | VPTELSAISMLYLD EYDKVVLKNYQE MVVEG | G | |
| B5FW51 | grow_factors | 28 | 3 | 32 | 31 | 1 | — | 0 | SRKALHVNFKD MGWDDWIIAPLE YEAFH | EGL | EFPLRSHLEPTNH AVIQTLMNSMDP ESTPPTC | VPTRLSPISILFIDSA NNVVYKQYEDMV VES | G | |
| B5X135 | grow_factors | 28 | 3 | 31 | 31 | 1 | — | 0 | RRHALYVDFSDV GWNDWIVAPPG YQAYY | HGE | PFPLADHLNSTNH AIVQTLVNSVNTN IPKAC | VPTELSAISMLYLD EHDKVVLKNYQE MVVEG | G | |
| B6DXF1 | grow_factors | 30 | 3 | 6 | 33 | 1 | — | 0 | RALERLVDIVSV YPSEVEHMFSPS CVSLLR | TGC | GDENLH | VPVETVNVTMQLL KIRSGDRPSYVELT FSQHVR | E | |
| B6LU94 | grow_factors | 28 | 3 | 32 | 31 | 1 | — | 0 | KRRKLYIRFKDV GWDDWIIAPQGY MAYH | SGE | PFPLNEHLNGTNH AVIQTLVNSLTPD SVPPAC | APTKWSSISMLYFD NNGDVVLRQYED MVVDG | G | |
| B6LUA7 | grow_factors | 28 | 3 | 32 | 31 | 1 | — | 0 | KRRKLYIRFKDV GWDDWIIAPQGY MAYH | SGE | PFPLNEHLNGTNH AVIQTLVNSLTPD SVPPAC | APTKWSSISMLYFD NNGDVVLRQYED MVVDG | G | |
| B6NUD9 | grow_factors | 28 | 3 | 32 | 31 | 1 | — | 0 | MRRSLQVSFHDL GWDDWIIAPTNY DAHY | AGA | SFPLRSHLEPTNH AIVQTLVNSMNPR AVEKVC | VPTKLSPISILYIDG KDTVVYKKYDDM VADQ | G | |
| B6NVZ7 | grow_factors | 28 | 3 | 32 | 31 | 1 | — | 0 | RRHSLYVDFSDV GWNDWIVAPPG YQAYY | HGE | PFPLADHLNSTNH AIVQTLVNSVNPL AVPKAC | VPTDLSPISMLYLN ENDQVVLKNYQD MVVEG | G | |
| B8NVZ8 | grow_factors | 28 | 3 | 32 | 31 | 1 | — | 0 | RRLHLYVDFREV GWQDWIIAPPGY HAYY | AGD | PFPLNEKLNGTNH AIIQTLVNTVAPA AVPRPC | APTALSAISMLYFD ESGNVVLRQYEDM VVEG | G | |

TABLE 2-continued

| name | class | Loop 1 length | Loop 2 length | Loop 3 length | Loop 4 length | Loop 5 length | Loop 6 length | # 3D structures | Loop 1 | Loop 2 | Loop 3 | Loop 4 | Loop 5 | Loop 6 |
|---|---|---|---|---|---|---|---|---|---|---|---|---|---|---|
| B6P6C2 | grow_factors | 28 | 3 | 32 | 31 | 1 | — | 0 | MRRSLQVSFHDLGWDDWIIAPTNYDAHY | AGA | SFPLRSHLEPTNHAIVQTLVNSMNPRAVEKVC | VPTKLSPISILYIDGKDTVVYKKYDDMVADQ | G | |
| B6SCR4 | grow_factors | 28 | 3 | 32 | 31 | 1 | — | 0 | QRHPLYVDFSEVGWNDWIVAPPGYQGFY | KGE | PFHIADHLNTTNHAIVQTLMNSVNPNNVPPAC | VPTTLDAISMLFMNEHSKVVLKNYQDMVVDG | G | |
| B6SCR5 | grow_factors | 28 | 3 | 32 | 31 | 1 | — | 0 | QRHPLYVDFSEVGWNDWIVAPPGYQGFY | KGE | PFPLADHLNTTNHAIVQTLMNSVNPNNVPPAC | VPTTLDAISMLFMNEHSKVVLKNYQDMVVDG | G | |
| B6VAE7 | grow_factors | 30 | 3 | 6 | 36 | 1 | — | 0 | KPRETWRIGDEYPSLISQRFSPPCVSVMR | GGC | NDESLE | VPTEEANITMEVMSVSVSSTGSNPGMQNMQFVEHLR | D | |
| B6VAE8 | grow_factors | 30 | 3 | 6 | 36 | 1 | — | 0 | KPRETWRISDEYPSLTSQRFSPPCVSVMR | GGC | NDESLE | VPTEEANITMEVMSVSVSSTDSNPGMQNMQFVEHLH | D | |
| B6ZHB6 | grow_factors | 28 | 3 | 32 | 31 | 1 | — | 0 | HRRRLHVNFKEMGWDDWIIAPLEYDAYH | DGA | DFPIRSHLEPTNHAIIQTLINSMDPESTPPTC | VPTRLSPISILYIDSANNWYKQYEDMVVES | G | |
| B7NZI8 | grow_factors | 28 | 3 | 32 | 31 | 1 | — | 0 | SRKALHVNFKDMGWDDWIIAPLEYEAFH | EGL | EFPLRSHLEPTNHAVIQTLMNSMDPESTPPTC | VPTRLSPISILFIDSANNWYKQYEDMVVES | G | |
| B7QHX4 | grow_factors | 28 | 3 | 32 | 31 | 1 | — | 0 | RRFPLRVEFSHVGWNDWIVAPPSYEAYY | HGV | PFPLPDHLNGTNHAIVQTLVNSMRAGGVPNAC | VPTELSPVSLLYVDAFERVLKNYQDMVVEG | G | |
| B7ZPR8 | grow_factors | 28 | 3 | 31 | 31 | 1 | — | 0 | RRHSLYVDFSDVGWNDWIVAPPGYQAFY | HGD | PFPLADHLNSTNHAIVQTLVNSVNSSIPKAC | VPTELSAISMLYLDEYDKWLKNYQEMVVEG | G | |
| B7ZQN5 | grow_factors | 28 | 3 | 32 | 31 | 1 | — | 0 | SKKPLHVNFKELGWDDWIIAPLEYEAHH | EGV | DFPLRSHLEPTNHAIIQTLMNSMNPGSTPPSC | VPTKLTPISILYIDAGNNWYKQYEDMVVES | G | |
| B7ZRN7 | grow_factors | 28 | 3 | 31 | 31 | 1 | — | 0 | RRHPLYVDFSDVGWNDWIVAPPGYHAFY | HGE | PFPLADHLNSTNHAIVQTLVNSVNTNIPKAC | VPTELSAISMLYLDENEKWLKNYQDMVVEG | G | |
| B8A4Z0 | grow_factors | 30 | 3 | 6 | 33 | 1 | — | 0 | RPREMLVEIQQEYPDDTEHIFIPSCWLTR | AGC | NDEMME | TPTVTYNITLEIKRLKPLRHQGDIFMSFAEHSE | Q | |
| B8XA45 | grow_factors | 28 | 3 | 31 | 31 | 1 | — | 0 | RRHALYVDFSDVGWNDWIVAPPGYQAYY | HGE | PFPLADHLNSTNHAIVQTLVNSVNTNIPKAC | VPTELSAISMLYLDEHDKVVLKNYQEMVVEG | G | |
| B8XRZ3 | grow_factors | 28 | 3 | 31 | 31 | 1 | — | 0 | RRHALYVDFSDVGWNDWIVAPPGYQAYY | HGE | PFPLADHLNSTNHAIVQTLVNSVNTNIPKAC | VPTELSAISMLYLDEHDKVVLKNYQEMVVEG | G | |
| B8YPW1 | grow_factors | 28 | 3 | 32 | 31 | 1 | — | 0 | QRRPLFVDFAEVGWSDWIVAPPGYEAYF | QGD | PFPLADHLNGTNHAIVQTLVNSVDPALVPKAC | IPTQLSPISMLYMDEHNQVALKNYQDMMVMG | G | |
| B9EJ18 | grow_factors | 28 | 3 | 32 | 31 | 1 | — | 0 | KKHELYVSFRDLGWQDWILAPEGYAAFY | DGE | SFPLNAHMNATNHAIVQTLVHLMFPDHVPKPC | APTKLNAISVLYFDDSSNVILKKYRNMVVRS | G | |

TABLE 2-continued

| name | class | Loop 1 length | Loop 2 length | Loop 3 length | Loop 4 length | Loop 5 length | Loop 6 length | # 3D structures | Loop 1 | Loop 2 | Loop 3 | Loop 4 | Loop 5 | Loop 6 |
|---|---|---|---|---|---|---|---|---|---|---|---|---|---|---|
| C0HBA5 | grow_factors | 28 | 3 | 31 | 31 | 1 | — | 0 | RRHALYVDFSDVGWNEWIVAPPGYHAFY | HGE | PFPLADHLNSTNHAIVQTLVNSVNSNIPRAC | VPTELSPISLLYLDEYEKVILKNYQDMVVEG | G | |
| C0K3N1 | grow_factors | 30 | 3 | 6 | 34 | 1 | — | 0 | QPRETLVSILEEYPDKISKIFRPSCVAVLR | GGC | SDESLT | TSVGERITVELQVMQVTPKTLSSKIKVMKFREHTA | E | |
| C0K3N2 | grow_factors | 30 | 3 | 6 | 34 | 1 | — | 0 | QTRETLVSILEEHPHEISHLFKPSCVTVLR | GGC | SDESLT | TSTGKRSVGREIMRVDPHKETSKIEVMQFTEHTD | E | |
| C0K3N3 | grow_factors | 30 | 3 | 6 | 34 | 1 | — | 0 | QTREMLVSILDEYPSEVAHLFRPSCVTVLR | GGC | TDESLT | TATGKRSVGREIMRVDPRKGTSKIEVMQFTEHTE | E | |
| C0K3N4 | grow_factors | 30 | 3 | 6 | 33 | 1 | — | 0 | RPIETMVDIFQEYPDEVEYILKPPCVALMR | GGC | NDEALE | VPTELYNVTMEIMKLKPYQSQHHPMSFQQHSK | E | |
| C0K3N5 | grow_factors | 30 | 3 | 6 | 33 | 1 | — | 0 | RPVETMVDIFQEYPDEVEYIFKPSCVALMR | GGC | NDEALE | VPTEVYNVTMEIMKLKPFQSQHHPMSFQQHSK | E | |
| C0K3N6 | grow_factors | 30 | 3 | 6 | 34 | 1 | — | 0 | QTRETLVPILKEYPDEVSHLFKPSCVPVLR | GGC | SDESLT | TATGKHSVGREIMRVDPHKGTSKMEVMQFKEHTA | E | |
| C0K3N7 | grow_factors | 30 | 3 | 6 | 33 | 1 | — | 0 | RPIETMVDIFQDYPDEVEYILKPPCVALMR | GGC | NDEALE | VPTELYNVTMEIMKLKPYQSQHHPMSFQQHSK | E | |
| C0K3N8 | grow_factors | 30 | 3 | 6 | 34 | 1 | — | 0 | QARETLVPILQEYPDEISDIFRPSCVAVLR | SGC | TDESLK | TPVGKHTVDLQIMRVNPRITQSSKMEVMKFTEHTA | E | |
| C0K3N9 | grow_factors | 30 | 3 | 6 | 34 | 1 | — | 0 | QTRETLVSILQEHPDEISDIFRPSCVAVLR | SGC | TDESMK | TPVGKHTADIQIMRMNPRTHSSKMEVMKFMEHTA | E | |
| C1BJY6 | grow_factors | 30 | 3 | 6 | 33 | 1 | — | 0 | RPRELLVEILQEYPEEVEHIYIPSCWLTR | AGC | NDEMLQ | TPTSTHNITMEIKRIKPQRQQNDIFMSFTEHNS | E | |
| C3KGR8 | grow_factors | 30 | 3 | 6 | 33 | 1 | — | 0 | RPMEQLVDVEQEYPGEVEYIYMPACVPLWR | SGC | MDENLE | QASLKSNITLEVMRIHPMISMHHVLLTFVEHQR | E | |
| C3PT60 | grow_factors | 28 | 3 | 32 | 31 | 1 | — | 0 | SRKALHVNFKDMGWDDWIIAPLEYEAFH | EGL | EFPLRSHLEPTNHAVIQTLMNSMDPESTPPTC | VPTRLSPISILFIDSANNVYKQYEDMVVES | G | |
| C3SB59 | grow_factors | 28 | 3 | 31 | 31 | 1 | — | 0 | KRHPLYVDFSDVGWNDWIAPPGYHAFY | HGE | PFPLADHLNSTNHAIVQTLVNSVNSKIPKAC | VPTELSAISMLYLDENEKVVLKNYQDMVVEG | G | |
| O13107 | grow_factors | 28 | 3 | 31 | 31 | 1 | — | 0 | RRHALYVDFSDVGWNDWIVAPPGYQAYY | HGE | PFPLADHLNSTNHAIVQTLVNSVNTNIPKWC | VPTELSAISMLYLDETDRVVLKNYQEMVVEG | G | |
| O13108 | grow_factors | 28 | 3 | 31 | 31 | 1 | — | 0 | RRHALYVDFSDVGWNEWIVAPPGYHAFY | HGE | PFPLPDHLNSTNHAIVQTLVNSVNSNIPKAC | IPTELSPISLLYLDEYEKVILKNYQDMVVEG | G | |

TABLE 2-continued

| name | class | Loop 1 length | Loop 2 length | Loop 3 length | Loop 4 length | Loop 5 length | Loop 6 length | # 3D structures | Loop 1 | Loop 2 | Loop 3 | Loop 4 | Loop 5 | Loop 6 |
|---|---|---|---|---|---|---|---|---|---|---|---|---|---|---|
| O13109 | grow_factors | 28 | 3 | 31 | 31 | 1 | — | 0 | RRHSLYVDFSDVGWNDWIAPPGYHAFY | QGE | PFPLADHLNSTTNAMVQTLVNSVNSNIPRAC | VPTDLSPVSLLYLDEYERVILKNYQDMVVEG | G | |
| O19006 | grow_factors | 28 | 3 | 31 | 31 | 1 | — | 0 | KRHPLYVDFSDVGWNDWIAPPGYHAFY | HGE | PFPLADHLNSTNHAIVQTLVNSVNSKIPKAC | VPTELSAISMLYLDENEKVLKNYQDMVVEG | G | |
| O42303 | grow_factors | 28 | 3 | 32 | 31 | 1 | — | 0 | NRKQLHVNFKEMGWDDWIIAPLEYEAFH | DGV | DFPIRSHLEPTNHAIIQTLMNSMDPRSTPPTC | VPTRLSPISILYIDSANNVVYKQYEDMVVES | G | |
| O42571 | grow_factors | 30 | 3 | 6 | 33 | 1 | — | 0 | QVREILVDIFQEYPDEVEYIFKPSCVPLMR | AGC | NDESLE | VPTECYNITMQIMKIKPHISQHIMDMSFQQHSQ | E | |
| O42572 | grow_factors | 30 | 3 | 6 | 33 | 1 | — | 0 | QVREILVDIFQEYPDEVEYIFKPSCVPLMR | AGC | NDESLE | VPTECYNITMQIMKIKPHISQHIMDMSFQQHSQ | E | |
| O46564 | grow_factors | 28 | 3 | 31 | 31 | 1 | — | 0 | KRHPLYVDFSDVGWNDWIAPPGYHAFY | HGE | PFPLADHLNSTNHAIVQTLVNSVNSKIPKAC | VPTELSAISMLYLDENEKVLKNYQDMVVEG | G | |
| O46576 | grow_factors | 28 | 3 | 31 | 31 | 1 | — | 0 | RRHALYVDFSDVGWNDWIAPPGYQAFY | HGD | PFPLADHFNSTNHAIVQTLVNSVNSSIPKAC | VPTELSAISMLYLDEYDKVVLKNYQEMVVEG | G | |
| O57573 | grow_factors | 28 | 3 | 31 | 31 | 1 | — | 0 | RRHALYVDFSDVGWNEWIAPPGYHAFY | HGE | PFPLPDHLNSTNHAIVQTLVNSVNSNIPKAC | IPTELSPISLLYLDEYEKVILKNYQQDMVVEG | G | |
| O57574 | grow_factors | 28 | 3 | 31 | 31 | 1 | — | 0 | RRHALYVDFSDVGWNDWIAPPGYQAYY | HGE | PFPLADHLNSTNHAIVQTLVNSVNTNIPKAC | VPTELSAISMLYLDETDRVVLKNYQQEMVVEG | G | |
| O73682 | grow_factors | 30 | 3 | 6 | 33 | 1 | — | 0 | KTRELLVDIIQEYPDEIEHTYIPSCVVLMR | AGC | NDEALE | VPTETRNVTMEVLRVKQRVSQHNFQLSFTEHTK | E | |
| O73682-2 | grow_factors | 30 | 3 | 6 | 33 | 1 | — | 0 | KTRELLVDIIQEYPDEIEHTYIPSCVVLMR | AGC | NDEALE | VPTETRNVTMEVLRVKQRVSQHNFQLSFTEHTK | E | |
| O73818 | grow_factors | 28 | 3 | 31 | 31 | 1 | — | 0 | RRHSLYVDFSDVGWNDWIAPPGYQAFY | HGD | PFPLADHLNSTNHAIVQTLVNSVNASIPKAC | VPTELSAISMLYLDEYDKVVLKNYQEMVVEG | G | |
| O76851 | grow_factors | 28 | 3 | 32 | 31 | 1 | — | 0 | QRQDLYVDFSDVNWDDWIAPHGYHAFY | NGE | PFPLAEYMNATNHAIVQTLVNSVDPSLTPKPC | VPTELSPIAMLYVDECELVLKTYQQMAVEG | G | |
| O77643 | grow_factors | 30 | 3 | 6 | 33 | 1 | — | 0 | RPIETLVDIFQEYPDEIEFIFKPSCVPLMR | GGC | NDESLE | VPTEEFNITMQIMRIKPHQSQHIGEMSFLQHNK | E | |
| O88911 | grow_factors | 30 | 3 | 6 | 14 | 1 | — | 0 | RPIETLVDIFQEYPDEIEYIFKPSCVPLMR | AGC | NDEALE | VPTSESNVTMQTCK | S | |
| O93369 | grow_factors | 28 | 3 | 31 | 31 | 1 | — | 0 | RRHALYVDFSDVGWNEWIAPPGYHAFY | HGE | PFPLPDHLNSTNHAIVQTLVNSVNSNIPKAC | IPTELSPISLLYLDEYEKVILKNYQDMVVEG | G | |

TABLE 2-continued

| name | class | Loop 1 length | Loop 2 length | Loop 3 length | Loop 4 length | Loop 5 length | Loop 6 length | # 3D structures | Loop 1 | Loop 2 | Loop 3 | Loop 4 | Loop 5 | Loop 6 |
|---|---|---|---|---|---|---|---|---|---|---|---|---|---|---|
| O93573 | grow_factors | 28 | 3 | 32 | 31 | 1 | — | 0 | SRKPLHVNFKEL GWDDWIIAPLDY EAYH | EGV | DFPLRSHLEPTNH AIIQTLMNSMDPE STPSC | VPSKLSPISILYIDS GNNVVYKQYEDM VVET | G | |
| O96504 | grow_factors | 28 | 3 | 32 | 31 | 1 | — | 0 | RRHSLYVDFSDV GWNDWIVAPPG YQAYY | HGE | PFPLADHLNSTNH AIVQTLVNSVNPL AVPKAC | VPTDLSPISMLYLN ENDQVVLKNYQD MVVEG | G | |
| O97390 | grow_factors | 28 | 3 | 32 | 31 | 1 | — | 0 | RRKELNVDFKAV GWNDWIFAPPG YNAYY | DGS | HWPYDDHMNVT NHAIVQDLVNSID PRAAPKPC | VPTELSSLSLLYTD EHGAVVLKVYQD MVVEG | G | |
| P07713 | grow_factors | 28 | 3 | 32 | 31 | 1 | — | 0 | RRHSLYVDFSDV GWDDWIVAPLG YDAYY | HGK | PFPLADHFNSTNH AVVQTLVNNMNP GKVPKAC | VPTQLDSVAMLYL NDQSTVLKNYQE MTVVG | G | |
| P12643 | grow_factors | 28 | 3 | 31 | 31 | 1 | — | 0 | KRHPLYVDFSDV GWNDWIVAPPG YHAFY | HGE | PFPLADHLNSTNH AIVQTLVNSVNSK IPKAC | VPTELSAISMLYLD ENEKVVLKNYQD MVVEG | G | |
| P12644 | grow_factors | 28 | 3 | 31 | 31 | 1 | — | 0 | RRHSLYVDFSDV GWNDWIVAPPG YQAFY | HGD | PFPLADHLNSTNH AIVQTLVNSVNSS IPKAC | VPTELSAISMLYLD EYDKVVLKNYQE MVVEG | G | |
| P15691 | grow_factors | 30 | 3 | 6 | 33 | 1 | — | 0 | RPIETLVDIFQEY PDEIEFIFKPSCVP LMR | GGC | NDESLE | VPTEEFNITMQIMR IKPHQSQHIGEMSF LQHNK | E | |
| P15691-2 | grow_factors | 30 | 3 | 6 | 33 | 1 | — | 1 | RPIETLVDIFQEY PDEIEFIFKPSCVP LMR | GGC | NDESLE | VPTEEFNITMQIMR IKPHQSQHIGEMSF LQHNK | E | |
| P15692 | grow_factors | 30 | 3 | 6 | 33 | 1 | — | 1 | HPIETLVDIFQEY PDEIEYIFKPSCV PLMR | GGC | NDEGLE | VPTEESNITMQIMR IKPHQGQHIGEMSF LQHNK | E | |
| P15692-10 | grow_factors | 30 | 3 | 6 | 33 | 1 | — | 1 | HPIETLVDIFQEY PDEIEYIFKPSCV PLMR | GGC | NDEGLE | VPTEESNITMQIMR IKPHQGQHIGEMSF LQHNK | E | |
| P15692-2 | grow_factors | 30 | 3 | 6 | 33 | 1 | — | 1 | HPIETLVDIFQEY PDEIEYIFKPSCV PLMR | GGC | NDEGLE | VPTEESNITMQIMR IKPHQGQHIGEMSFLI KQHNK | E | |
| P15692-3 | grow_factors | 30 | 3 | 6 | 33 | 1 | — | 1 | HPIETLVDIFQEY PDEIEYIFKPSCV PLMR | GGC | NDEGLE | VPTEESNITMQIMR IKPHQGQHIGEMSF LQHNK | E | |
| P15692-4 | grow_factors | 30 | 3 | 6 | 33 | 1 | — | 1 | HPIETLVDIFQEY PDEIEYIFKPSCV PLMR | GGC | NDEGLE | VPTEESNITMQIMR IKPHQGQHIGEMSF LQHNK | E | |
| P15692-5 | grow_factors | 30 | 3 | 6 | 33 | 1 | — | 1 | HPIETLVDIFQEY PDEIEYIFKPSCV PLMR | GGC | NDEGLE | VPTEESNITMQIMR IKPHQGQHIGEMSF LQHNK | E | |
| P15692-6 | grow_factors | 30 | 3 | 6 | 33 | 1 | — | 1 | HPIETLVDIFQEY PDEIEYIFKPSCV PLMR | GGC | NDEGLE | VPTEESNITMQIMR IKPHQGQHIGEMSF LQHNK | E | |
| P15692-7 | grow_factors | 30 | 3 | 6 | 33 | 1 | — | 1 | HPIETLVDIFQEY PDEIEYIFKPSCV PLMR | GGC | NDEGLE | VPTEESNITMQIMR IKPHQGQHIGEMSF LQHNK | E | |

TABLE 2-continued

| name | class | Loop 1 length | Loop 2 length | Loop 3 length | Loop 4 length | Loop 5 length | Loop 6 length | # 3D structures | Loop 1 | Loop 2 | Loop 3 | Loop 4 | Loop 5 | Loop 6 |
|---|---|---|---|---|---|---|---|---|---|---|---|---|---|---|
| P15692-8 | grow_factors | 30 | 3 | 6 | 33 | 1 | — | 1 | HPIETLVDIFQEY PDEIEYIFKPSCV PLMR | GGC | NDEGLE | VPTEESNITMQIMR IKPHQGQHIGEMSF LQHNK | E | |
| P15692-9 | grow_factors | 30 | 3 | 6 | 33 | 1 | — | 1 | HPIETLVDIFQEY PDEIEYIFKPSCV PLMR | GGC | NDEGLE | VPTEESNITMQIMR IKPHQGQHIGEMSF LQHNK | E | |
| P16612 | grow_factors | 30 | 3 | 6 | 33 | 1 | — | 0 | RPIETLVDIFQEY PDEIEYIFKPSCV PLMR | AGC | NDEALE | VPTSESNVTMQIM RIKPHQSQHIGEMS FLQHSR | E | |
| P16612-2 | grow_factors | 30 | 3 | 6 | 33 | 1 | — | 0 | RPIETLVDIFQEY PDEIEYIFKPSCV PLMR | AGC | NDEALE | VPTSESNVTMQIM RIKPHQSQHIGEMS FLQHSR | E | |
| P16612-3 | grow_factors | 30 | 3 | 6 | 33 | 1 | — | 0 | RPIETLVDIFQEY PDEIEYIFKPSCV PLMR | AGC | NDEALE | VPTSESNVTMQIM RIKPHQSQHIGEMS FLQHSR | E | |
| P16612-4 | grow_factors | 30 | 3 | 6 | 33 | 1 | — | 0 | RPIETLVDIFQEY PDEIEYIFKPSCV PLMR | AGC | NDEALE | VPTSESNVTMQIM RIKPHQSQHIGEMS FLQHSR | E | |
| P18075 | grow_factors | 28 | 3 | 32 | 31 | 1 | — | 0 | KKHELYVSFRDL GWQDWIIAPEGY AAFY | EGE | AFPLNSYMNATN HAIVQTLVHFINP ETVPKPC | APTQLNAISVLYFD DSSNVILKKYRNM VVRA | G | |
| P20722 | grow_factors | 28 | 3 | 32 | 31 | 1 | — | 0 | KKHELYVSFQDL GWQDWIIAPKGY AANY | DGE | SFPLNAHMNATN HAIVQTLVHLMN PEYVPKPC | APTKLNAISVLYFD DNSNVILKKYRNM VVRA | G | |
| P21274 | grow_factors | 28 | 3 | 31 | 31 | 1 | — | 0 | KRHPLYVDFSDV GWNDWIVAPPG YHAFY | HGE | PFPLADHLNSTNH AIVQTLVNSVNSK IPKAC | VPTELSAISMLYLD ENEKVLKNYQDM VVEG | G | |
| P21275 | grow_factors | 28 | 3 | 31 | 31 | 1 | — | 0 | RRHSLYVDFSDV GWNDWIVAPPG YQAFY | HGD | PFPLADHLNSTNH AIVQTLVNSVNSS IPKAC | VPTELSAISMLYLD EYDKVLKNYQEM VVEG | G | |
| P22003 | grow_factors | 28 | 3 | 32 | 31 | 1 | — | 0 | KKHELYVSFRDL GWQDWIIAPEGY AAFY | DGE | SFPLNAHMNATN HAIVQTLVHLMFP DHVPKPC | APTKLNAISVLYFD DSSNVILKKYRNM VVRS | G | |
| P22004 | grow_factors | 28 | 3 | 32 | 31 | 1 | — | 0 | RKHELYVSFQDL GWQDWIIAPKGY AANY | DGE | SFPLNAHMNATN HAIVQTLVHLMN PEYVPKPC | APTKLNAISVLYFD DNSNVILKKYRNM VVRA | G | |
| P23359 | grow_factors | 28 | 3 | 32 | 31 | 1 | — | 0 | KKHELYVSFRDL GWQDWIIAPEGY AAFY | EGE | AFPLNSYMNATN HAIVQTLVHFINP DTVPKPC | APTQLNAISVLYFD DSSNVILKKYRNM VVRA | G | |
| P25703 | grow_factors | 28 | 3 | 31 | 31 | 1 | — | 0 | RRHPLYVDFSDV GWNDWIVAPPG YHAFY | HGE | PFPLADHLNSTNH AIVQTLVNSVNTN IPKAC | VPTELSAISMLYLD ENEKVLKNYQD MVVEG | G | |
| P26617 | grow_factors | 30 | 3 | 6 | 33 | 1 | — | 0 | RPIEMLVDIFQEY PDEIEYIFKPSCV PLMR | GGC | NDESLE | VPTEEFNITMQIMR IKPHQGQHIGEMSF LQHSK | E | |
| P30884 | grow_factors | 28 | 3 | 31 | 31 | 1 | — | 0 | RRHPLYVDFSDV GWNDWIVAPPG YHAFY | HGE | PFPLADHLNSTNH AIVQTLVNSVNTN IPKAC | VPTELSAISMLYLD ENEKVVLKNYQD MVVEG | G | |

TABLE 2-continued

| name | class | Loop 1 length | Loop 2 length | Loop 3 length | Loop 4 length | Loop 5 length | Loop 6 length | # 3D structures | Loop 1 | Loop 2 | Loop 3 | Loop 4 | Loop 5 | Loop 6 |
|---|---|---|---|---|---|---|---|---|---|---|---|---|---|---|
| P30885 | grow_factors | 28 | 3 | 31 | 31 | 1 | — | 0 | RRHSLYVDFSDVGWNDWIAPPGYQAFY | HGD | PFPLADHLNSTNHAIVQTLVNSVNSSIPKAC | VPTELSAISMLYLDEYDKVVLKNYQEMVVEG | G | |
| P35621 | grow_factors | 28 | 3 | 32 | 31 | 1 | — | 0 | KPRRLYIDFKDVGWQDWIIAPQGYLANY | HGE | PFPLSESLNGTNHAIIQTLVHSFDPKGTPQPC | VPIKLSPISMLYYDNNDNVVLRHYEDMVVDE | G | |
| P43026 | grow_factors | 28 | 3 | 32 | 31 | 1 | — | 0 | SRKALHVNFKDMGWDDWIIAPLEYEAFH | EGL | EFPLRSHLEPTNHAVIQTLMNSMDPESTPPTC | VPTRLSPISILFIDSANNVVYKQYEDMVVES | G | |
| P43027 | grow_factors | 28 | 3 | 32 | 31 | 1 | — | 0 | SRKALHVNFKDMGWDDWIIAPLEYEAFH | EGL | EFPLRSHLEPTNHAVIQTLMNSMDPESTPPTC | VPTRLSPISILFIDSANNVVYKQYEDMVVES | G | |
| P43028 | grow_factors | 28 | 3 | 32 | 31 | 1 | — | 0 | SRKPLHVNFKELGWDDWIIAPLEYEAYH | EGV | DFPLRSHLEPTNHAIIQTLMNSMDPGSTPSC | VPTKLTPISILYIDAGNNVVYKQYEDMMVVRA | G | |
| P43029 | grow_factors | 28 | 3 | 32 | 31 | 1 | — | 0 | SRKSLHVDFKELGWDDWIIAPLDYEAYH | EGV | DFPLRSHLEPTNHAIIQTLLNSMAPDAAPASC | VPARLSPISILYIDAANNVVYKQYEDMVVEA | G | |
| P43029-2 | grow_factors | 28 | 3 | 32 | 31 | 1 | — | 0 | SRKSLHVDFKELGWDDWIIAPLDYEAYH | EGV | DFPLRSHLEPTNHAIIQTLLNSMAPDAAPASC | VPARLSPISILYIDAANNVVYKQYEDMVVEA | G | |
| P48969 | grow_factors | 28 | 3 | 32 | 31 | 1 | — | 0 | KRKNLFVNFEDLDWQEWIIAPLGYVAFY | QGE | AFPLNGHANATNHAIVQTLVHHMSPSHVPQPC | APTKLSPITVLYYDDSRNVVLKKYKNMVVRA | G | |
| P48970 | grow_factors | 28 | 3 | 32 | 31 | 1 | — | 0 | QRHRLFVSFRDVGWENWIIAPMGYQAYY | DGE | PFPLGERLNGTNHAIIQTLVNSIDNRAVPKVC | APTKLSGISMLYFDNNENVVLRQYEDMVVEA | G | |
| P49001 | grow_factors | 28 | 3 | 31 | 31 | 1 | — | 0 | KRHPLYVDFSDVGWNDWIAPPGYHAFY | HGE | PFPLADHLNSTNHAIVQTLVNSVNSKIPKAC | VPTELSAISMLYLDENEKVVLKNYQDMVVEG | G | |
| P49003 | grow_factors | 28 | 3 | 32 | 31 | 1 | — | 0 | KKHELYVSFRDLGWQDWIIAPEGYAAFY | DGE | SFPLNAHMNATNHAIVQTLVHLMFPDHVPKPC | APTKLNAISVLYFDDSSNVILKKYRNMVVRS | G | |
| P49151 | grow_factors | 30 | 3 | 6 | 33 | 1 | — | 0 | RPIETLVDIFQEYPDEIEYIFKPSCVPLMR | GGC | NDEGLE | VPTEEFNITMQIMRIKPHQGQHIGEMSFLQHNK | E | |
| P49763 | grow_factors | 30 | 3 | 6 | 33 | 1 | — | 0 | RALERLVDVVSEYPSEVEHMFSPSCVSLLR | TGC | GDENLH | VPVETANVTMQLLKIRSGDRPSYVELTFSQHVR | E | |
| P49763-2 | grow_factors | 30 | 3 | 6 | 33 | 1 | — | 0 | RALERLVDVVSEYPSEVEHMFSPSCVSLLR | TGC | GDENLH | VPVETANVTMQLLKIRSGDRPSYVELTFSQHVR | E | |
| P49763-3 | grow_factors | 30 | 3 | 6 | 33 | 1 | — | 0 | RALERLVDVVSEYPSEVEHMFSPSCVSLLR | TGC | GDENLH | VPVETANVTMQLLKIRSGDRPSYVELTFSQHVR | E | |
| P49764 | grow_factors | 30 | 3 | 6 | 34 | 1 | — | 0 | RPMEKLVYILDEYPDEVSHIFSPSCVLLSR | SGC | GDEGLH | VPIKTANITMQILKIPPNRDPHFYVEMTFSQDVL | E | |

TABLE 2-continued

| name | class | Loop 1 length | Loop 2 length | Loop 3 length | Loop 4 length | Loop 5 length | Loop 6 length | # 3D structures | Loop 1 | Loop 2 | Loop 3 | Loop 4 | Loop 5 | Loop 6 |
|---|---|---|---|---|---|---|---|---|---|---|---|---|---|---|
| P50412 | grow_factors | 30 | 3 | 6 | 33 | 1 | — | 0 | RPIETLVDIFQEY PDEIEFIFKPSCVP LMR | GGC | NDESLE | VPTEEFNTMQIMR IKPHQSQHIGEMSF LQHNK | E | |
| P55106 | grow_factors | 28 | 3 | 32 | 31 | 1 | — | 0 | SKKPLHVNFKEL GWDDWIIAPLEY EAYH | EGV | DFPLRSHLEPTNH AIIQTLMNSMDPG STPPSC | VPTKLTPISILYIDA GNNVVYNEYEEM VVES | G | |
| P67860 | grow_factors | 30 | 3 | 6 | 33 | 1 | — | 0 | RPIETMVDIFQDY PDEVEYILKPPCV ALMR | GGC | NDEALE | VPTELYNVTMEIM KLKPYQSQHHPM SFQQHSK | E | |
| P67860-2 | grow_factors | 30 | 3 | 6 | 33 | 1 | — | 0 | RPIETMVDIFQDY PDEVEYILKPPCV ALMR | GGC | NDEALE | VPTELYNVTMEIM KLKPYQSQHHPM SFQQHSK | E | |
| P67860-3 | grow_factors | 30 | 3 | 6 | 33 | 1 | — | 0 | RPIETMVDIFQDY PDEVEYILKPPCV ALMR | GGC | NDEALE | VPTELYNVTMEIM KLKPYQSQHHPM SFQQHSK | E | |
| P67861 | grow_factors | 30 | 3 | 6 | 34 | 1 | — | 0 | QTRETLVSILQEH PDEISDIFRPSCV AVLR | SGC | TDESMK | TPVGKHTADIQIMR MNPRTHSSKMEV MKFMEHTA | E | |
| P67862 | grow_factors | 30 | 3 | 6 | 34 | 1 | — | 0 | QTRETLVPILKEY PDEVSHLFKPSC VPVLR | GGC | SDESLT | TATGKHSVGREIM RVDPHKGTSKMEV MQFKEHTA | E | |
| P67863 | grow_factors | 30 | 3 | 6 | 34 | 1 | — | 0 | QARETLVPILQE YPDEISDIFRPSC VAVLR | SGC | TDESLK | TPVGKHTVDLQIM RVNPRTQSSKMEV MKFTEHTA | E | |
| P67964 | grow_factors | 30 | 3 | 6 | 33 | 1 | — | 0 | RTIETLVQIFQEY PDEVEYIFRPSCV PLMR | AGC | GDEGLE | VPVDVYNVTMEIA RIKPHQSQHIAHMS FLQHSK | D | |
| P67965 | grow_factors | 30 | 3 | 6 | 33 | 1 | — | 0 | RTIETLVDIFQEY PDEVEYIFRPSCV PLMR | AGC | GDEGLE | VPVDVYNVTMEIA RIKPHQSQHIAHMS FLQHSK | D | |
| P67965-2 | grow_factors | 30 | 3 | 6 | 33 | 1 | — | 0 | RTIETLVDIFQEY PDEVEYIFRPSCV PLMR | AGC | GDEGLE | VPVDVYNVTMEIA RIKPHQSQHIAHMS FLQHSK | D | |
| P67965-3 | grow_factors | 30 | 3 | 6 | 33 | 1 | — | 0 | RTIETLVDIFQEY PDEVEYIFRPSCV PLMR | AGC | GDEGLE | VPVDVYNVTMEIA RIKPHQSQHIAHMS FLQHSK | D | |
| P67985-4 | grow_factors | 30 | 3 | 6 | 33 | 1 | — | 0 | RTIETLVDIFQEY PDEVEYIFRPSCV PLMR | AGC | GDEGLE | VPVDVYNVTMEIA RIKPHQSQHIAHMS FLQHSK | D | |
| P82475 | grow_factors | 30 | 3 | 6 | 34 | 1 | — | 0 | QARETLVSILQE YPDEISDIFRPSC VAVLR | SGC | TDESLK | TPVGKHTVDMQIM RVNPRTQSSKMEV MKFTEHTA | E | |
| P83906 | grow_factors | 30 | 3 | 6 | 33 | 1 | — | 0 | RPVETMVDIFQE YPDEVEYIFKPSC VALMR | GGC | NDEALE | VPTEMYNVTMEV MKLKPFQSQHIHP VSFQQHSK | E | |
| P83942 | grow_factors | 30 | 3 | 6 | 34 | 1 | — | 0 | QARETLVSILQE YPDEISDIFRPSC VAVLR | SGC | TDESLK | TPVGKHTVDLQIM RVNPRTQSSKMEV MKFTEHTA | E | |

TABLE 2-continued

| name | class | Loop 1 length | Loop 2 length | Loop 3 length | Loop 4 length | Loop 5 length | Loop 6 length | # 3D structures | Loop 1 | Loop 2 | Loop 3 | Loop 4 | Loop 5 | Loop 6 |
|---|---|---|---|---|---|---|---|---|---|---|---|---|---|---|
| P85857 | grow_factors | 28 | 3 | 32 | 31 | 1 | — | 0 | SKKALHVNFKEL GWDDWIIAPLDY EAYH | EGV | DFPLRSHLEPTNH AIIQTLMNSMDPN STPSC | VPTKLSPISILYIDS GNNVVYKQYEDM VVEQ | G | |
| P87373 | grow_factors | 28 | 3 | 32 | 31 | 1 | — | 0 | KKHELYVSFRDL GWQDWIIAPEGY AAFY | DGE | SFPLNAHMNATN HAIVQTLVHLMFP DHVPKPC | APTKLNAISVLYFD DSSNVILKKYRNM VVRS | G | |
| P91706 | grow_factors | 28 | 3 | 32 | 31 | 1 | — | 0 | RRHSLYVDFSDV GWDDWIVAPLG YDAYY | HGK | PFPLADHFNSTNH AWQTLVNNMNP GKVPKAC | VPTQLDSVAMLYL NDQSTVVLKNYQE MTVVG | G | |
| P91720 | grow_factors | 28 | 3 | 32 | 31 | 1 | — | 0 | RRHSLYVDFQDV GWSDWIVAPPG YDAYY | HGK | QFPLADHLNSTNH AWQTLVNNLNPG KVPKAC | VPTQLEGISMLYLN DQRTVLKNYQD MTVVG | G | |
| Q00731 | grow_factors | 30 | 3 | 6 | 33 | 1 | — | 0 | RPIETLVDIFQEY PDEIEYIFKPSCV PLMR | AGC | NDEALE | VPTSESNITMQIMR IKPHQSQHIGEMSF LQHSR | E | |
| Q00731-2 | grow_factors | 30 | 3 | 6 | 33 | 1 | — | 0 | RPIETLVDIFQEY PDEIEYIFKPSCV PLMR | AGC | NDEALE | VPTSESNITMQI MRIKPHQSQHIGE MSFLQHSR | E | |
| Q00731-3 | grow_factors | 30 | 3 | 6 | 33 | 1 | — | 0 | RPIETLVDIFQEY PDEIEYIFKPSCV PLMR | AGC | NDEALE | VPTSESNITMQIMR IKPHQSQHIGEMSF LQHSR | E | |
| Q00731-4 | grow_factors | 30 | 3 | 6 | 40 | 1 | — | 0 | RPIETLVDIFQEY PDEIEYIFKPSCV PLMR | AGC | NDEALE | VPTSESNITMQVGT CGTGDGAGAGGG RRTVQGGALEGC L | L | |
| Q04906 | grow_factors | 28 | 3 | 32 | 31 | 1 | — | 0 | KKHELYVSFQDL GWQDWIIAPKGY AANY | DGE | SFPLNAHMNATN HAIVQTLVHLMN PEYVPKPC | APTKLNAISVLYFD DNSNVILKKYRNM VVRA | G | |
| Q06826 | grow_factors | 28 | 3 | 31 | 31 | 1 | — | 0 | RRHSLYVDFSDV GWNDWIVAPPG YQAFY | HGD | PFPLADHLNSTNH AIVQTLVNSVNSS IPKAC | VPTELSAISMLYLD EYDKVVLKNYQE MVVEG | G | |
| Q07G81 | grow_factors | 30 | 3 | 6 | 33 | 1 | — | 0 | QVREILVDIFQEY PDEVEYIFKPSCV PLMR | AGC | NDESLE | VPTESYNITMQIMK IKPHISQHIMDMSF QQHSQ | E | |
| Q0P6N0 | grow_factors | 28 | 3 | 31 | 31 | 1 | — | 0 | QRHPLYVDFTDV GWNDWIVAPPG YHAFY | TGV | PYPIAKHLNATNH AIVQTIMNTVDSN VPNAC | IPTTLNPISILSLNEF DKVVLKNYKDMVI EG | G | |
| Q0QY10 | grow_factors | 30 | 3 | 6 | 33 | 1 | — | 0 | RPREMLVEIQQE YPDDTEHIFIPSC WLTR | AGC | NDEMME | TPTVTYNITLEIKRL KPLRHQGDIFMSFA EHSE | Q | |
| Q17JZ3 | grow_factors | 28 | 3 | 32 | 31 | 1 | — | 0 | QRRPLYVDFSDV GWSDWIVAPPG YEAYY | HGD | QFPIADHLNTTNH AIVQTLVNSINPSL APKAC | VPTQLSSISMLYLN EQNKVVLKNYQD MTVVG | G | |
| Q19T09 | grow_factors | 30 | 3 | 6 | 33 | 1 | — | 0 | RPIETLVOIFQEY PDEIEFIFKPSCVP LMR | GGC | NDESLE | VPTEEFNITMQIMR IKPHQSQHIGEMSF LQHNK | E | |
| Q1ANK8 | grow_factors | 30 | 3 | 6 | 33 | 1 | — | 0 | RPREMLVEIQQE YPDDTEHIFIPSC WLTR | AGC | NDEMME | TPTVTYNITLEIKRL KPLRHQGDIFMSFA EHSE | Q | |

TABLE 2-continued

| name | class | Loop 1 length | Loop 2 length | Loop 3 length | Loop 4 length | Loop 5 length | Loop 6 length | # 3D structures | Loop 1 | Loop 2 | Loop 3 | Loop 4 | Loop 5 | Loop 6 |
|---|---|---|---|---|---|---|---|---|---|---|---|---|---|---|
| Q1ECU5 | grow_factors | 30 | 3 | 6 | 33 | 1 | — | 0 | RPREMLVEIQQEYPDDTEHIFIPSCWLTR | AGC | NDEMME | TPTVTYNITLEIKRLKPLRHQGDIFMSFAEHSE | Q | |
| Q1PHR6 | grow_factors | 28 | 3 | 32 | 31 | 1 | — | 0 | KKRSLWSFRELGWQDWIIAPDGYSAFY | NGE | SFPLNAHMNATNHAIVQTLVHLMDPEAVPKPC | APTKLNAISVLYFDDSSNVILKKYRNMIVKS | G | |
| Q1PHR7 | grow_factors | 28 | 3 | 32 | 31 | 1 | — | 0 | KRHELYVDFNDVGWNDWIVAPPGYHAFY | HGE | PFPIAEHLNSTNHAIVQTLVNSVSPDSVPKAC | VPTDLSPISMLYLDEFDKVVLKNYQDMVVEG | G | |
| Q1WKY6 | grow_factors | 28 | 3 | 32 | 31 | 1 | — | 0 | RRHSLYVDFSDVGWDDWIVAPLGYDAYY | HGK | PFPLADHFNSTNHAVVQTLVNNMNPGKVPKAC | VPTQLDSVAMLYLNDQSTVVLKNYQEMTVVG | G | |
| Q1WKY7 | grow_factors | 28 | 3 | 32 | 31 | 1 | — | 0 | RRHSLYVDFSDVGWDDWIVAPLGYDAYY | HGK | PFPLADHFNSTNHAVVQTLVNNMNPGKVPKAC | VPTQLDSVAMLYLNDQSTVVLKNYQEMTVVG | G | |
| Q1WKY8 | grow_factors | 28 | 3 | 32 | 31 | 1 | — | 0 | RRHSLYVDFSDVGWDDWIVAPLGYDAYY | HGK | PFPLADHFNSTNHAVVQTLVNNMNPGKVPKAC | VPTQLDSVAMLYLNDQSTVVLKNYQEMTVVG | G | |
| Q25211 | grow_factors | 28 | 3 | 32 | 31 | 1 | — | 0 | QRRPLFVDFADVGWSDWIVAPHGYDAYY | QGD | PFPLSDHLNGTNHAIVQTLVNSVNPAAVPKAC | VPTQLSSISMLYMDEVNNVVLKNYQDMMVVG | G | |
| Q264B8 | grow_factors | 28 | 3 | 32 | 31 | 1 | — | 0 | RRHPLYVDFREVGWDDWIVAPPGYEGWY | HGD | PFPLSAHMNSTNHAVVQTLMNSMNPGLVPKAC | IPTQLTSISMLYLDEESKVVLKNYHEMAVVG | G | |
| Q27W10 | grow_factors | 28 | 3 | 32 | 31 | 1 | — | 0 | QRQALHVSFRKLRWQDWVIAPEGYSAFY | SGE | SFPLNANMNATNHAIVQTLVHLMNPKTVPKPC | APTELSPISVLYFDQDNNVVLKKYNKMVVKA | G | |
| Q29607 | grow_factors | 28 | 3 | 32 | 31 | 1 | — | 0 | RRHSLYVDFSDVGWNDWIVAPPGYQAFY | HGD | PFPLADHLNSTNHAIVQTLVNSVNSSIPKAC | VPTELSAISMLYLDEYDKVVLKNYQEMVVEG | G | |
| Q2KJH1 | grow_factors | 28 | 3 | 31 | 31 | 1 | — | 0 | RRHSLYVDFSDVGWNDWIVAPPGYQAFY | HGD | PFPLADHLNSTNHAIVQTLVNSVNSSIPKAC | VPTELSAISMLYLDEYDKVVLKNYQEMVVEG | G | |
| Q2KT33 | grow_factors | 28 | 3 | 31 | 31 | 1 | — | 0 | RRHSLYVDFSDVGWNDWIVAPPGYQAFY | HGD | PFPLADHLNSTNHAIVQTLVNSVNSSIPKAC | VPTELSAISMLYLDEYDKVVLKNYQEMVVEA | G | |
| Q2NKW7 | grow_factors | 28 | 3 | 32 | 31 | 1 | — | 0 | SRKALHVNFKDMGWDDWIIAPLEYEAFH | EGL | EFPLRSHLEPTNHAVIQTLMNSMDPESTPPTC | VPTRLSPISILFIDSANNVYKQYEDMVVES | G | |
| Q2VEW5 | grow_factors | 28 | 3 | 31 | 31 | 1 | — | 0 | RRHPLYVDFSDVGWNDWIVAPPGYHAFY | QGD | PFPLTDHLNSTNHAIVQTLVNSVNSSIPRAC | VPTELSAISMLYLDEYDKVVLKNYQEMVVEG | G | |
| Q2WBX0 | grow_factors | 28 | 3 | 32 | 31 | 1 | — | 0 | RRHPLYVDFSDVGWDDWIVAPPGYRAYF | NGE | GFPLPEYTNATNHAIVQTLVHSVNPEAVPRPC | VPTELSPISMLYVDEHDKVTLKNYQDMVVVG | G | |
| Q330H7 | grow_factors | 28 | 3 | 32 | 32 | 1 | — | 0 | RRKRMYVDFRLLGWSDWIIAPQGYDAYL | EGE | KYPIDNYLRPTNHATVQTIVNSLDPSIAPKAC | TPNELSPISILYTEDGSNNVVYKNYKDMVVER | G | |

TABLE 2-continued

| name | class | Loop 1 length | Loop 2 length | Loop 3 length | Loop 4 length | Loop 5 length | Loop 6 length | # 3D structures | Loop 1 | Loop 2 | Loop 3 | Loop 4 | Loop 5 | Loop 6 |
|---|---|---|---|---|---|---|---|---|---|---|---|---|---|---|
| Q330KB | grow_factors | 30 | 3 | 6 | 34 | 1 | — | 0 | QTREMLVPILKE YPNEVSHLFKPS CVPVLR | GGC | SDESLT | TATGKRSVGREVM RVDPHKGTSKIEV MQFKEHTA | E | |
| Q38KY2 | grow_factors | 30 | 3 | 6 | 33 | 1 | — | 0 | RPRELLVDIYQE YPEEIEHTYIPSC WLMR | GGC | NDEALE | VPVATRNVTLEVK RVKLHVTQHNFLIS FTEHTS | D | |
| Q3LSL9 | grow_factors | 28 | 3 | 32 | 31 | 1 | — | 0 | RRHNLYVDFSDV GWNDWIAPPG YQAYY | HGE | PFPLADHLNSTNH AIVQTLVNSVNPQ LVPKAC | VPTELSPISMLYLD EADKVVLKNYQD MVVEG | G | |
| Q3LSM3 | grow_factors | 28 | 3 | 32 | 31 | 1 | — | 0 | SRKALHVNFKD MGWDDWIIAPLE YEAFH | EGL | EFPLRSHLEPTNH AVIQTLMNSMDP ESTPPTC | VPTRLSPISILFIDSA NNVYKQYEDMV VES | G | |
| Q3ULR1 | grow_factors | 28 | 3 | 31 | 31 | 1 | — | 0 | RRHSLYVDFSDV GWNDWIAPPG YQAFY | HGD | PFPLADHLNSTNH AIVQTLVNSVNSS IPKAC | VPTELSAISMLYLD EYDKVVLKNYQE MVVEG | G | |
| Q3UXB2 | grow_factors | 28 | 3 | 32 | 31 | 1 | — | 0 | KKHELYVSFQDL GWQDWIIAPKGY AANY | DGE | SFPLNAHMNATN HAIVQTLVHLMN PEYVPKPC | APTKLNAISVLYFD DNSNVILKKYRNM VVRA | G | |
| Q3V114 | grow_factors | 28 | 3 | 31 | 31 | 1 | — | 0 | KRHPLYVDFSDV GWNDWIAPPG YHAFY | HGE | PFPLADHLNSTNH AIVQTLVNSVNSQ IPKAC | VPTELSAISMLYLD ENEKVVLKNYQD MVVEG | G | |
| Q496P8 | grow_factors | 28 | 3 | 32 | 31 | 1 | — | 0 | KKHELYVSFRDL GWQDWIIAPEGY AAFY | DGE | SFPLNAHMNATN HAIVQTLVHLMFP DHVPKPC | APTKLNAISVLYFD OSSNVILKKYRNM VVRS | G | |
| Q496P9 | grow_factors | 28 | 3 | 32 | 31 | 1 | — | 0 | KKHELYVSFRDL GWQDWIIAPEGY AAFY | DGE | SFPLNAHMNATN HAIVQTLVHLMFP DHVPKPC | APTKLNAISVLYFD DSSNVILKKYRNM VVRS | G | |
| Q497W8 | grow_factors | 28 | 3 | 31 | 31 | 1 | — | 0 | KRHPLYVDFSDV GWNDWIAPPG YHAFY | HGE | PFPLADHLNSTNH AIVQTLVNSVNSK IPKAC | VPTELSAISMLYLD ENEKVVLKNYQD MVVEG | G | |
| Q4H2P7 | grow_factors | 28 | 3 | 32 | 31 | 1 | — | 0 | QRHSMWVDFEE MGWSDWVIAPR AFQSYR | AGE | PFPLSGKLNGTNH AMLMTMMNSVD PSNTPMPC | VPTRLSSVSMLYL DKKDNVVLRLYED MVVEA | G | |
| Q4JCQ2 | grow_factors | 28 | 3 | 32 | 31 | 1 | — | 0 | RKHELYVSFQDL GWQDWIIAPKGY AANY | DGE | SFPLNAHMNATN HAIVQTLVHLMN PEYVPKPC | APTKLNAISVLYFD DNSNVILKKYRNM VVRA | G | |
| Q4LEV0 | grow_factors | 28 | 3 | 31 | 31 | 1 | — | 0 | RRHSLYVDFSDV GWNDWIAPPG YQAFY | HGD | PFPLADHLNSTNH AIVQTLVNSVNSS IPKAC | VPTELSAISMLYLD EYDKVVLKNYQE MVVEG | G | |
| Q4R5W6 | grow_factors | 28 | 3 | 32 | 31 | 1 | — | 0 | KKHELYVSFRDL GWQDWIIAPEGY AAFY | DGE | SFPLNAHMNATN HAIVQTLVHLMFP DHVPKPC | APTKLNAISVLYFD DSSNVILKKYRNM VVRS | G | |
| Q4RLY8 | grow_factors | 30 | 3 | 6 | 34 | 1 | — | 0 | RITEKLVEWQEY PTEVEYITYSPSCV PLVR | AGC | GDEKLE | HPTTTNVTMQLL KIRPSEPHKEYVH MITVEHQT | E | |
| Q4RMK1 | grow_factors | 28 | 3 | 31 | 31 | 1 | — | 0 | RRHSLYVDFSDV GWNDWIAPPG YQAYY | HGD | PFPLADHLNSTNH AIVQTLVNSVNSN IPKAC | VPTELSAISMLYLD EHDKVVLKNYQE MVVEG | G | |

TABLE 2-continued

| name | class | Loop 1 length | Loop 2 length | Loop 3 length | Loop 4 length | Loop 5 length | Loop 6 length | # 3D structures | Loop 1 | Loop 2 | Loop 3 | Loop 4 | Loop 5 | Loop 6 |
|---|---|---|---|---|---|---|---|---|---|---|---|---|---|---|
| Q4RQB0 | grow_factors | 28 | 3 | 32 | 31 | 1 | — | 0 | KKHELYVSFRDLGWQDWILAPEGYAAFY | DGE | AFPLNAHMNATNHAIVQTLVHLMFPDNVPKPC | APTKLNAISVLYFDDSSNVILKKYRNMVVRS | G | |
| Q4SCW7 | grow_factors | 30 | 3 | 6 | 34 | 1 | — | 0 | QPMEQLVDVEQEYPGELEYTYMPSCVPLKR | SGC | GDEHLE | QPTLESNVTLQVIKIQQTWSMHYVEITFVEHQR | E | |
| Q4SSW6 | grow_factors | 28 | 3 | 32 | 31 | 1 | — | 0 | SRKALHVNFKELGWDDWILAPLDYEAHH | EGV | DFPLRSHLEPTNHAIIQTLMNSMDPNSTPPSC | VPTKLSPISILYIDSGNNVVYKQYEDMVVEQ | G | |
| Q4SV40 | grow_factors | 30 | 3 | 6 | 33 | 1 | — | 0 | QPRDVLVDVFQAYPEDTEHIYTPSCVVLKR | GGC | NDEGKE | VPAESRNVTLQLQRFRPRVIKEVVDLSFTEHVL | V | |
| Q4SZ19 | grow_factors | 28 | 3 | 32 | 31 | 1 | — | 0 | KARRLYIDFKDVGWQDWILAPQGYMANY | HGE | PFPLSDSLNGTNHAILQTLVHSLDPHGTPQPC | VPIRLSPISMLYYDNNDNVVLRHYQDMVVDE | G | |
| Q4U4G1 | grow_factors | 30 | 3 | 6 | 33 | 1 | — | 0 | KPRPMVFRVHDEYPTLTSQRFNPPCVTLMR | GGC | NDESLE | VPTEEANVTMQLMGASVSGGNGMQHLSFVEHKK | D | |
| Q4VBA3 | grow_factors | 28 | 3 | 32 | 31 | 1 | — | 0 | RKHELYVSFQDLGWQDWILAPKGYAANY | DGE | SFPLNAHMNATNHAIVQTLVHLMNPEYVPKPC | APTKLNAISVLYFDDNSNVILKKYRNMVVRA | G | |
| Q53XC5 | grow_factors | 28 | 3 | 31 | 31 | 1 | — | 0 | RRHSLYVDFSDVGWNDWIVAPPGYQAFY | HGD | PFPLADHLNSTNHAIVQTLVNSVNSSIPKAC | VPTELSAISMLYLDEYDKVVLKNYQEMVVEG | G | |
| Q53XY6 | grow_factors | 30 | 3 | 6 | 33 | 1 | — | 0 | RALERLVDVVSEYPSEVEHMFSPSCVSLLR | TGC | GDENLH | VPVETANVTMQLLKIRSGDRPSYVELTFSQHVR | E | |
| Q54OI2 | grow_factors | 30 | 3 | 6 | 33 | 1 | — | 0 | RTIETLVDIFQEYPDEVEYIFRPSCVPLMR | AGC | GDEGLE | VPVDVYNVTMEIARIKPHQSQHIAHMSFLQHSK | D | |
| Q54IS7 | grow_factors | 30 | 3 | 6 | 33 | 1 | — | 0 | RPIETLVDIFQEYPDEIEYIFKPSCVPLMR | AGC | NDEALE | VPTSESNVTMQIMRIKPHQSQHIGEMSFLQHSR | E | |
| Q544A5 | grow_factors | 30 | 3 | 6 | 34 | 1 | — | 0 | RPMEKLVYILDEYPDEVSHIFSPSCVLLSR | SGC | GDEGLH | VPIKTANITMQILKIPPNRDPHFYVEMTFSQDVL | E | |
| Q58E94 | grow_factors | 28 | 3 | 31 | 31 | 1 | — | 0 | RRHPLYVDFSDVGWNDWIVAPPGYHAFY | HGE | PFPLADHLNSTNHAIVQTLVNSVNTNIPKAC | VPTELSAISMLYLDENEKVVLKNYQDMVVEG | G | |
| Q58G88 | grow_factors | 28 | 3 | 32 | 33 | 1 | — | 0 | QRHSLYVSFREVGWQDWILAPMGYQAYF | SGE | PFPLNDRLNGTNHAIIQTLVNSMDPSSVPKVC | APTKLSAISMLYFDNDENVVLRQYEDMVVEA | G | |
| Q59FH5 | grow_factors | 30 | 3 | 6 | 33 | 1 | — | 1 | HPIETLVDIFQEYPDEIEYIFKPSCVPLMR | GGC | NDEGLE | VPTEESNTTMQIMRIKPHQGQHIGEMSFLQHNK | E | |
| Q5I4I9 | grow_factors | 28 | 3 | 31 | 31 | 1 | — | 0 | RRHSLYVDFSDVGWNDWIVAPPGYQAFY | HGD | PFPLADHLNSTNHAIVQTLVNSVNSSIPKAC | VPTELSAISMLYLDEYDKVVLKNYQEMVVEG | G | |

TABLE 2-continued

| name | class | Loop 1 length | Loop 2 length | Loop 3 length | Loop 4 length | Loop 5 length | Loop 6 length | # 3D structures | Loop 1 | Loop 2 | Loop 3 | Loop 4 | Loop 5 | Loop 6 |
|---|---|---|---|---|---|---|---|---|---|---|---|---|---|---|
| Q5RHW5 | grow_factors | 30 | 3 | 6 | 33 | 1 | — | 0 | RPREMLVEIQQEYPDDTEHIFPSCWLTR | AGC | NDEMME | TPTVTYNITLEIKRLKPLRHQGDIFMSFAEHSE | Q | |
| Q5RKN7 | grow_factors | 28 | 3 | 32 | 31 | 1 | — | 0 | KPRRLYIDFKDVGWQDWIIAPQGYLANY | HGE | PFPLSESLNGTNHAILQTLVHSFDPKGTPQPC | VPIKLSPISMLYYDNNDNVVLRHYEDMVVDE | G | |
| Q5YJC3 | grow_factors | 28 | 3 | 32 | 32 | 1 | — | 0 | RRKRMYDFRLLGWSDWIIAPQGYDAYL | EGE | KYPIONYLRPTNHAIVQTIVNSLDPSIAPKAC | TPNELSPISILYTEDGSNNVVYKNYKDMVVER | G | |
| Q63434 | grow_factors | 30 | 3 | 6 | 34 | 1 | — | 0 | RPMEKLVYIADEHPNEVSHIFSPSCVLLSR | SGC | GDEGLH | VALKTANITMQILKIPPNRDPHSYVEMTFSQDVL | E | |
| Q64FZ6 | grow_factors | 30 | 3 | 6 | 33 | 1 | — | 0 | RPIETLVDIFQEYPDEIEYIFKPSCVPLMR | AGC | NDEALE | VPTSESNVTMQIMRIKPHQSQHIGEMSFLQHSR | E | |
| Q66KL4 | grow_factors | 28 | 3 | 32 | 31 | 1 | — | 0 | KKRRLYIDFKDVGWQNWVIAPRGYMANY | YGE | PYPLTEMLRGTNHAVLQTLVHSVEPESTPLPC | APTKLSPISMLYYDNNDNVVLRHYEDMVVDE | G | |
| Q68KG0 | grow_factors | 28 | 3 | 32 | 32 | 1 | — | 0 | SKKPLHVNFKDMGWDDWIIAPLEYEAYH | EGL | EFPLRSHLEPTNHAVIQTLMNSMDPETTPPTC | VPTRLSPISILYTDSANNVVYKQYEDMVVES | G | |
| Q6AYU9 | grow_factors | 28 | 3 | 31 | 31 | 1 | — | 0 | RRHSLYVDFSDVGWNDWIVAPPGYQAFY | HGD | PFPLADHLNSTNHAIVQTLVNSVNSSIPKAC | VPTELSAISMLYLDEYDKVVLKNYQEMVVEG | G | |
| Q6EH35 | grow_factors | 28 | 3 | 31 | 31 | 1 | — | 0 | KRHPLYVDFNDVGWNDWIAPPGYGAFY | HGE | PFPLADHLNTTNHAIVQTLVNSVNSKIPKAC | VPTELSAISMLYLDENEKVVLKNYQDMVVEG | G | |
| Q6H8S7 | grow_factors | 30 | 3 | 6 | 33 | 1 | — | 0 | RTREMLVDVFQEYPDEIEHTYIPSCWLMR | AGC | NDEALE | VPTETKNVTMEVIQVKQRVSQHHFLLSFTEHRK | E | |
| Q6H8S8 | grow_factors | 30 | 3 | 6 | 33 | 1 | — | 0 | RTREMLVDVFQEYPDEIEHTYIPSCVVLMR | AGC | NDEALE | VPTETKNVTMEVIQVKQRVSQHHFLLSFTEHRK | E | |
| Q6HA10 | grow_factors | 28 | 3 | 32 | 31 | 1 | — | 0 | SRKPLHVNFKELGWDDWIIAPLEYEAYH | EGV | DFPLRSHLEPTNHAIIQTLMNSMDPGSTPPSC | VPTKLTPISILYIDAGNNVVYKQYEDMVVES | G | |
| Q63S4 | grow_factors | 28 | 3 | 31 | 31 | 1 | — | 0 | QRQPLYVDFREVGWDDWIVAPPGYNAYF | QGE | PFPLADHLNSTNHAIVQTLVNSVNASIPRAC | VPTELSPISMLYMDEYEKVVLKNYQDMVVEG | G | |
| Q63S5 | grow_factors | 28 | 3 | 31 | 31 | 1 | — | 0 | RRHALYVDFREVGWNDWIVAPPGYHAYF | HGE | PFPLADHLNSTNHAIVQTLVNSVNASIPRAC | VPTELSPISMLYLDEYGKVVLKNYQDMVVEG | G | |
| Q63S6 | grow_factors | 28 | 3 | 31 | 31 | 1 | — | 0 | ARYPLYVDFSDVGWNDWIVAPPGYNAFF | QGE | HFPLPQHLNSTNHAIVQTLVNSVNPEVPRAC | IPTELTPIALLYLDEYEKVVLKNYQDMVVEG | G | |
| Q6J936 | grow_factors | 30 | 3 | 6 | 34 | 1 | — | 0 | QPRETLVSILEEYPGELAHIFRPSCVTALR | GGC | TDESLE | TATGKRSVGREIMRLSPHKGTSEKEVMQFTEHTD | E | |

TABLE 2-continued

| name | class | Loop 1 length | Loop 2 length | Loop 3 length | Loop 4 length | Loop 5 length | Loop 6 length | # 3D structures | Loop 1 | Loop 2 | Loop 3 | Loop 4 | Loop 5 | Loop 6 |
|---|---|---|---|---|---|---|---|---|---|---|---|---|---|---|
| Q6KF10 | grow_factors | 28 | 3 | 32 | 31 | 1 | — | 0 | SKKPLHVNFKEL GWDDWILAPLEY EAYH | EGV | DFPLRSHLEPTNH AIIQTLMNSMDPG STPSC | VPTKLTPISILYIDA GNNVYKQYEDM VVES | G | |
| Q6P4J4 | grow_factors | 28 | 3 | 32 | 31 | 1 | — | 0 | KKHELYVSFKDL GWQDWILAPEGY AAFY | EGE | AFPLNSYMNATN HAIVQTLVHFINP DTVPKPC | APTQLNPISVLYFD DSSNVILKKYRNM VVRA | G | |
| Q6PAF3 | grow_factors | 28 | 3 | 31 | 31 | 1 | — | 0 | RRHSLYVDFSDV GWNDWIAPPG YQAFY | HGD | PFPLADHLNSTNH AIVQTLVNSVNAS IPKAC | VPTELSAISMLYLD EYDKVVLKNYQE MVVEG | G | |
| Q6R5A5 | grow_factors | 30 | 3 | 6 | 45 | 1 | — | 0 | RPMPTTVRVSDE YPNDTSERYNPQ CVTLMR | GGC | NDESLE | VPTETSNVTMQLM VTSAHNGGSNDNG SGGGIGSGMREMS FLQHNK | E | |
| Q6RF65 | grow_factors | 28 | 3 | 31 | 31 | 1 | — | 0 | RRHSLYVDFSDV GWNDWIVAPPG YQAFY | HGD | PFPLADHLNSTNH AIVQTLVNSVNSS IPKAC | VPTELSAISMLYLD EYDKVVLKNYQE MVVEG | G | |
| Q6TVI2 | grow_factors | 30 | 3 | 6 | 41 | 1 | — | 0 | QPMKTPVKVSDE YPDNTNDRHSPP CVTLMR | GGC | NDESLE | VPTETSNVTMQIM TTSAYNDGGTSGGI SSGMREMSFLQHN K | E | |
| Q6WZM0 | grow_factors | 30 | 3 | 6 | 37 | 1 | — | 0 | HPIETLVDIFQEY PDEIEYIFKPSCV PLMR | GGC | NDEGLE | VPTEESNITMQVGI FGKWGKGGIGRGV TLWEQWPGR | L | |
| Q6XDQ0 | grow_factors | 28 | 3 | 31 | 31 | 1 | — | 0 | KRHPLYVDFENDV GWNDWIVAPPG YSAFY | HGE | PFPLADHLNSTNH AIVQTLVNSVNSK IPKAC | VPTELSAISMLYLD ENEKVVLKNYQD MVVEG | G | |
| Q6YLN3 | grow_factors | 30 | 3 | 6 | 33 | 1 | — | 0 | RPIETLVDIFQEY PDEIEYIFKPSCV PLMR | AGC | NDEALE | VPTSESNITMQIMR IKPHQSQHIGEMSF LQHSR | E | |
| Q75N54 | grow_factors | 28 | 3 | 31 | 31 | 1 | — | 0 | KRHALYVDFSDV GWNEWIVAPPG YHAFY | HGE | PFPLADHLNSTNH AIVQTLVNSVNSN IPRAC | VPTDLSPISLLYLD EYEKVILKNYQDM VVEG | G | |
| Q75RY1 | grow_factors | 28 | 3 | 32 | 31 | 1 | — | 0 | SRKPLHVDFKEL GWDDWILAPLDY EAYH | EGL | DFPLRSHLEPTNH AIIQTLLNSMAPD AAPASC | VPARLSPISILYIDA ANNVYKQYEDM VVEA | G | |
| Q75WK6 | grow_factors | 28 | 3 | 32 | 31 | 1 | — | 0 | RRHPLYVDFVDV GWNDWIVAPPG YDAFY | HGD | PFPLADHLNSTNH AIVQTLVYSTPN IVPKAC | VPTALSSISMLYLD EENKVVLKNYQD MAVLG | G | |
| Q772M8 | grow_factors | 30 | 3 | 6 | 33 | 1 | — | 0 | KPRPMVFRVHDE HPELTSQRFNPPC VTLMR | GGC | NDESLE | VPTEEANVTMQLM GASVSGGNGMQH LSFVEHKK | D | |
| Q78DH3 | grow_factors | 28 | 3 | 31 | 31 | 1 | — | 0 | RRHALYVDFSDV GWNDWIVAPPG YQAYY | HGE | PFPLADHLNSTNH AIVQTLVNSVNN NIPKAC | VPTELSAISMLYLD EHDKVVLKNYQE MVVEG | G | |
| Q7BDH4 | grow_factors | 28 | 3 | 31 | 31 | 1 | — | 0 | RRHALYVDFSDV GWNDWIVAPPG YQAYY | HGE | PFPLADHLNSTNH AIVQTLVNSVNN NIPKAC | VPTELSAISMLYLD EHDKVVLKNYQE MVVEG | G | |

TABLE 2-continued

| name | class | Loop 1 length | Loop 2 length | Loop 3 length | Loop 4 length | Loop 5 length | Loop 6 length | # 3D structures | Loop 1 | Loop 2 | Loop 3 | Loop 4 | Loop 5 | Loop 6 |
|---|---|---|---|---|---|---|---|---|---|---|---|---|---|---|
| Q78DH5 | grow_factors | 28 | 3 | 31 | 31 | 1 | — | 0 | RRHALYVDFSDV GWNDWIVAPPG YQAFY | HGE | PFPLADHLNSTNH AIVQTLVNSVNN NIPKAC | VPTELSAISMLYLD EHDKVVLKNYQE MVVEG | G | |
| Q78DH6 | grow_factors | 28 | 3 | 31 | 31 | 1 | — | 0 | RRHALYVDFSDV GWNDWIVAPPG YQAFY | HGE | PFPLADHLNSTNH AIVQTLVNSVNN NIPKAC | VPTELSAISMLYLD EHDKVVLKNYQE MVVEG | G | |
| Q7Q3Q7 | grow_factors | 28 | 3 | 32 | 31 | 1 | — | 0 | QRKPLYVDFSDV GWNDWIVAPPG YEAFY | QGD | RFPIADHLNTTNH AIVQTLVNSYNPT LAPKAC | VPTQLSSISMLYLN EQNKVVLKNYQD MTVVG | G | |
| Q7T288 | grow_factors | 28 | 3 | 32 | 31 | 1 | — | 0 | KKHELYVSFRDL GWQDWIIAPEGY AAFY | DGE | SFPLNAHMNATN HAIVQTLVHLMFP DNVPKPC | APTKLNAISVLYFD DSSNVILKKYRNM VVRS | G | |
| Q7Z4P5 | grow_factors | 28 | 3 | 32 | 31 | 1 | — | 0 | SRKPLHVDFKEL GWDDWIIAPLDY EAYH | EGL | DFPLRSHLEPTNH AIIQTLLNSMAPD AAPASC | VPARLSPISILYIDA ANNVVYKQYEDM VVEA | G | |
| Q804S2 | grow_factors | 28 | 3 | 31 | 31 | 1 | — | 0 | KRHALYVDFSDV GWNEWIVAPPG YHAFY | QGE | PFPLADHLNSTNH AIVQTLVNSVNSN IPRAC | VPTDLSPISLLYLD EYEKVILKNYQDM VVEG | G | |
| Q804S3 | grow_factors | 28 | 3 | 31 | 31 | 1 | — | 0 | KRHALYVDFSDV GWNEWIVAPPG YHAFY | QGE | PFPLADHLNSTNH AIVQTLVNSVNSN IPRAC | VPTDLSPISLLYLD EYEKVILKNYMDM VVEG | G | |
| Q811S3 | grow_factors | 28 | 3 | 31 | 31 | 1 | — | 0 | RRHSLYVDFSDV GWNDWIVAPPG YQAFY | HGD | PFPLADHLNSTNH AIVQTLVNSVNSS IPKAC | VPTELSAISMLYLD EYDKVVLKNYQE MVVEG | G | |
| Q866G4 | grow_factors | 30 | 3 | 6 | 33 | 1 | — | 0 | QPIETLVDIFQEY PDEIEYIFKPSCV PLVR | GGC | NDESLE | VPTEEFNVTMQIM RIKPHQGQHIGEMS FLQHNK | E | |
| Q869A4 | grow_factors | 28 | 3 | 32 | 31 | 1 | — | 0 | RRHALYVDFSDV GWNDWIIAPPGY NAYF | HGD | PFPLPDHLNTTNH AIVQTLVNSANPA AVPRAC | VPTELSPISMLYKD KFDNVVLKNYQD MVVEG | G | |
| Q86RL7 | grow_factors | 28 | 3 | 32 | 31 | 1 | — | 0 | RRHALYVDFQEV GWEQWIVAPDG YNAYF | QGD | NFPLAQHLNSTNH AIVQTLVNSVDPT AVSKAC | VPTELSAISMLYLN ERGKVQLKNYQD MVVEA | G | |
| Q8BRW3 | grow_factors | 28 | 3 | 32 | 31 | 1 | — | 0 | KKHELYVSFQDL GWQDWIIAPKGY AANY | DGE | SFPLNAHMNATN HAIVQTLVHLMN PEYVPKPC | APTKLNAISVLYFD DNSNVILKKYRNM VVRA | G | |
| Q8BRW9 | grow_factors | 28 | 3 | 32 | 31 | 1 | — | 0 | SRKALHVNFKD MGWDDWIIAPLE YEAFH | EGL | EFPLRSHLEPTNH AVIQTLMNSMDP ESTPPTC | VPTRLSPISILFIDSA NNVVYKQYEDMV VES | G | |
| Q8CCE0 | grow_factors | 28 | 3 | 32 | 31 | 1 | — | 0 | KKHELYVSFRDL GWQDWIIAPEGY AAFY | DGE | SFPLNAHMNATN HAIVQTLVHLMFP DHVPKPC | APTKLNAISVLYFD DSSNVILKKYRNM VVRS | G | |
| Q8HY70 | grow_factors | 30 | 3 | 6 | 33 | 1 | — | 0 | RPIETLVDIFQEY PDEIEYIFKPSCV PLMR | GGC | NDEGLE | VPTEEFNTMQIMR IKPHQGQHIGEMSF LQHSK | E | |
| Q8HY75 | grow_factors | 30 | 3 | 6 | 33 | 1 | — | 0 | RPVERLVDIVSE YPSEVEHMFSPS CVSLMR | TGC | SDETMH | MPLETANVTMQL MKYHSLDQPFFVE MSFSQHVR | E | |

TABLE 2-continued

| name | class | Loop 1 length | Loop 2 length | Loop 3 length | Loop 4 length | Loop 5 length | Loop 6 length | # 3D structures | Loop 1 | Loop 2 | Loop 3 | Loop 4 | Loop 5 | Loop 6 |
|---|---|---|---|---|---|---|---|---|---|---|---|---|---|---|
| Q8IAE3 | grow_factors | 28 | 3 | 32 | 31 | 1 | — | 0 | SKHSLYVDFAIV GWDSWLAPEGY QAYY | QGE | PYPMPEHLNPTNH AIVQTIVHSADPSS VPKAC | VPTELDTLNMLYL NEKEQIILKNYKD MIVTS | G | |
| Q8JFE2 | grow_factors | 28 | 3 | 31 | 31 | 1 | — | 0 | RRHALYVDFSDV GWNDWIVAPPG YQAYY | HGE | PFPLADHLNSTNH AIVQTLVNSVNN NIPKAC | VPTELSAISMLYLD EHDKVVLKNYQE MVVEG | G | |
| Q8JIJ2 | grow_factors | 28 | 3 | 31 | 31 | 1 | — | 0 | RRHALYVDFSDV GWNDWIVAPPG YQAYY | HGE | PFPLADHLNSTNH AIVQTLVNSVNN NIPKAC | VPTELSAISMLYLD EHDKVVLKNYQE MVVEG | G | |
| Q8JIJ3 | grow_factors | 28 | 3 | 31 | 31 | 1 | — | 0 | RRHALYVDFSDV GWNDWIVAPPG YQAYY | HGE | PFPLADHLNSTNH AIVQTLVNSVNN NIPKAC | VPTELSAISMLYLD EHDKVVLKNYQE MVVEG | G | |
| Q8JIJ4 | grow_factors | 28 | 3 | 31 | 31 | 1 | — | 0 | RRHALYVDFSDV GWNDWIVAPPG YQAYY | HGE | PFPLADHLNSTNH AIVQTLVNSVNN NIPKAC | VPTELSAISMLYLD EHDKVVLKNYQE MVVEG | G | |
| Q8JIJ5 | grow_factors | 28 | 3 | 31 | 31 | 1 | — | 0 | RRHALYVDFSDV GWNDWIVAPPG YQAYY | HGE | PFPLADHLNSTNH AIVQTLVNSVNN NIPKAC | VPTELSAISMLYLD EHDKVVLKNYQE MVVEG | G | |
| Q8JIJ6 | grow_factors | 28 | 3 | 31 | 31 | 1 | — | 0 | RRHALYVDFSDV GWNDWIVAPPG YQAYY | HGE | PFPLADHLNSTNH AIVQTLVNSVNN NIPKAC | VPTELSAISMLYLD EHDKVVLKNYQE MVVEG | G | |
| Q8JIJ7 | grow_factors | 28 | 3 | 31 | 31 | 1 | — | 0 | RRHALYVDFSDV GWNDWIVAPPG YQAYY | HGE | PFPLADHLNSTNH AIVQTLVNSVNN NIPKAC | VPTELSAISMLYLD EHDKVVLKNYQE MVVEG | G | |
| Q8JIJ8 | grow_factors | 28 | 3 | 31 | 31 | 1 | — | 0 | RRHALYVDFSDV GWNDWIVAPPG YQAYY | HGE | PFPLADHLNSTNH AIVQTLVNSVNN NIPKAC | VPTELSAISMLYLD EHDKVVLKNYQE MVVEG | G | |
| Q8JIJ9 | grow_factors | 28 | 3 | 31 | 31 | 1 | — | 0 | RRHALYVDFSDV GWNDWIVAPPG YQAYY | HGE | PFPLADHLNSTNH AIVQTLVNSVNN NIPKAC | VPTELSAISMLYLD EHDKVVLKNYQE MVVEG | G | |
| Q8JIK0 | grow_factors | 28 | 3 | 31 | 31 | 1 | — | 0 | RRHALYVDFSDV GWNDWIVAPPG YQAYY | HGE | PFPLADHLNSTNH AIVQTLVNSVNN NIPKAC | VPTELSAISMLYLD EHDKVVLKNYQE MVVEG | G | |
| Q8JIK1 | grow_factors | 28 | 3 | 31 | 31 | 1 | — | 0 | RRHALYVDFSDV GWNDWIVAPPG YQAYY | HGE | PFPLADHLNSTNH AIVQTLVNSVNN NIPKAC | VPTELSAISMLYLD EHDKVVLKNYQE MVVEG | G | |
| Q8JIK2 | grow_factors | 28 | 3 | 31 | 31 | 1 | — | 0 | RRHALYVDFSDV GWNDWIVAPPG YQAYY | HGE | PFPLADHLNSTNH AIVQTLVNSVNN NIPKAC | VPTELSAISMLYLD EHDKVVLKNYQE MVVEG | G | |
| Q8MJV5 | grow_factors | 28 | 3 | 31 | 31 | 1 | — | 0 | RRHSLYVDFSDV GWNDWIVAPPG YQAFY | HGD | PFPLADHLNSTNH AIVQTLVNSVNSS IPKAC | VPTELSAISMLYLD EYDKVVLKNYQE MVVEG | G | |
| Q8MWG4 | grow_factors | 28 | 3 | 32 | 31 | 1 | — | 0 | KRHVLYVDFGD VGWNDWIVAPP GYNAYF | RGE | PFPMGQHLNSTH HAVMQTLVHSVD PTAVPKAC | VPSDLSAISMLYLD ELDKVVLKNYQD MVVEG | G | |
| Q8MXC2 | grow_factors | 28 | 3 | 32 | 31 | 1 | — | 0 | QRHPLYVDFSEV GWNDWIAPPG YQGFY | KGE | PFPLADHLNTTNH AIVQTLMNSVNP NNVPPAC | VPTTLEAISMLFMN EHSKVVLKNYQD MVVDG | G | |

TABLE 2-continued

| name | class | Loop 1 length | Loop 2 length | Loop 3 length | Loop 4 length | Loop 5 length | Loop 6 length | # 3D structures | Loop 1 | Loop 2 | Loop 3 | Loop 4 | Loop 5 | Loop 6 |
|---|---|---|---|---|---|---|---|---|---|---|---|---|---|---|
| Q8MXZ3 | grow_factors | 28 | 3 | 32 | 31 | 1 | — | 0 | KRKNLFVNFEDLDWQEWIIAPLGYVAFY | QGE | AFPLNGHANATNHAIVQTLVHHMSPSTVPQPC | APTKLSPITVLYYDDSRNVLKKYKNMVVRA | G | |
| Q8SPL5 | grow_factors | 30 | 3 | 6 | 33 | 1 | — | 0 | RPIETLVDIFQEYPDEIEYIFKPSCVPLMR | GGC | NDEGLE | VPTAEFNITMQIMRIKPHQSQHIGEMSFLQHSK | E | |
| Q8SP29 | grow_factors | 30 | 3 | 6 | 33 | 1 | — | 0 | RPIETLVDIFQEYPDEIEYIFKPSCVPLMR | GGC | NDEGLE | VPTEEFNITMQIMRIKPHQGQHIGEMSFLQHNK | E | |
| Q8WMQ4 | grow_factors | 30 | 3 | 6 | 33 | 1 | — | 0 | RPIETLVDIFQEYPDEIEYIFKPSCVPLMR | GGC | NDEGLE | VPTEEFNIAMQIMRIKPHQGQHIGEMSFLQHNK | E | |
| Q8WS99 | grow_factors | 28 | 3 | 32 | 31 | 1 | — | 0 | RRHPLYVDFTDVGWNSWIVAPAGYQAYY | QGE | PFPLVDHLNATNHAIVQTLVNSASPQLAPKAC | VPTDLSAISMLYLDDSDSVILRNYQDMVVEG | G | |
| Q90723 | grow_factors | 28 | 3 | 32 | 31 | 1 | — | 0 | KPRRLYISFSDVGWENWIIAPQGYMANY | LGE | PFPLTAELNSTNHAILQTMVHSLDPEGTPQPC | VPVRLSPISILYYDNSDNVVLRHYEDMVVDE | G | |
| Q90751 | grow_factors | 28 | 3 | 31 | 31 | 1 | — | 0 | KRHPLYVDFNDVGWNDWIVAPPGYSAFY | HGE | PFPLADHLNSTNHAIVQTLVNSVNSKIPKAC | VPTELSAISMLYLDENEKVVLKNYQDMVVEG | G | |
| Q90752 | grow_factors | 28 | 3 | 31 | 31 | 1 | — | 0 | RRHALYVDFESDVGWNDWIVAPPGYQAFY | HGD | PFPLADHLNSTNHAIVQTLVNSVNSSIPKAC | VPTELSAISMLYLDEYDKVVLKNYQEMVVEG | G | |
| Q90X23 | grow_factors | 30 | 3 | 6 | 34 | 1 | — | 0 | QPRETLVSILEEYPGEISHIFRPSCVTALR | GGC | TDESLE | TATGKRSVGREIMRLSPHKGTSEKEVMQFTEHTD | E | |
| Q90X24 | grow_factors | 30 | 3 | 6 | 34 | 1 | — | 0 | QTRETLVSILEEHPDEVSHIFRPSCVTALR | GGC | TDESLK | TATGKRSVGREIMRVDPHKGTSKTEVMQFTEHTD | E | |
| Q90Y81 | grow_factors | 28 | 3 | 31 | 31 | 1 | — | 0 | RRHALYVDFREVGWNDWIVAPPGYHAYF | HGE | PFPLADHLNSTNHAIVQTLVNSVNASIPRAC | VPTELSPISMLYLDEYGKVVLKNYQDMVVEG | G | |
| Q90Y82 | grow_factors | 28 | 3 | 31 | 31 | 1 | — | 0 | ARYPLYVDFSDVGWNDWIVAPPGYNAFF | QGE | HFPLPQHLNSTNHAIVQTLVNSVNPEVPRAC | IPTELTPIALLYLDEYEKVVLKNYQDMVVEG | G | |
| Q90YD6 | grow_factors | 28 | 3 | 31 | 31 | 1 | — | 0 | RRHSLYVDFSDVGWNDWIVAPPGYQAFY | HGD | PFPLADHLNSTNHAIVQTLVNSVNSSIPKAC | VPTDLSAISMLYLDEYDKVVLKNYQEMVVEG | G | |
| Q90YD7 | grow_factors | 28 | 3 | 31 | 31 | 1 | — | 0 | RRHPLYVDFSDVGWNDWIVAPPGYHAFY | HGE | PFPLADHLNSTNHAIVQTLVNNVNPNIPKAC | VPTELSAISMLYLDENEKVVLKNYQDMVVEG | G | |
| Q91403 | grow_factors | 28 | 3 | 32 | 31 | 1 | — | 0 | KKHELYVSFRDLGWQDWIIAPEGYAAYY | EGE | AFPLNSYMNATNHAIVQTLVHFINPETVPKPC | APTQLNAISVIYFDDSSNVILKKYRNMVVRA | G | |
| Q91703 | grow_factors | 28 | 3 | 31 | 31 | 1 | — | 0 | RRHSLYVDFSDVGWNDWIAPPGYQAFY | HGD | PFPLADHLNSTNHAIVQTLVNSVNASIPKAC | VPTELSAISMLYLDEYDKVVLKNYQEMVVEG | G | |

TABLE 2-continued

| name | class | Loop 1 length | Loop 2 length | Loop 3 length | Loop 4 length | Loop 5 length | Loop 6 length | # 3D structures | Loop 1 | Loop 2 | Loop 3 | Loop 4 | Loop 5 | Loop 6 |
|---|---|---|---|---|---|---|---|---|---|---|---|---|---|---|
| Q95LQ4 | grow_factors | 30 | 3 | 6 | 33 | 1 | — | 0 | RPIETLVDIFQEYPDEIEYIFKPSCVPLMR | GGC | NDEGLE | VPTEEFNITMQIMRIKPHQGQHIGEMSFLQHSK | E | |
| Q95NE5 | grow_factors | 30 | 3 | 6 | 33 | 1 | — | 1 | HPIETLVDIFQEYPDEIEYIFKPSCVPLMR | GGC | NDEGLE | VPTEESNITMQIMRIKPHQGQHIGEMSFLQHNK | E | |
| Q95W38 | grow_factors | 28 | 3 | 32 | 31 | 1 | — | 0 | RRHPLYVDFREVGWDDWIVAPPGYEAWY | HGD | PFPLSAHMNSTNHAWQTLMNSMNPGLVPKAC | VPTQLTSISMLYLDEESKWLKNYHEMAVVG | G | |
| Q98950 | grow_factors | 28 | 3 | 32 | 31 | 1 | — | 0 | KPRRLYISFSDVGWENWIIAPQGYMANY | LGE | PFPLTAELNSTNHAILQTMVHSLDPEGTPQPC | VPVRLSPISILYYDNSDNVVLRHYEDMVVDE | G | |
| Q99PS1 | grow_factors | 30 | 3 | 6 | 33 | 1 | — | 0 | HPIETLVDIFQEYPDEIEYIFKPSCVPLMR | GGC | SDEALE | VPTSESNITMQIMRVKPHQSQHIGEMSFLQHSR | E | |
| Q9BDP7 | grow_factors | 30 | 3 | 6 | 33 | 1 | — | 1 | HPIETLVDIFQEYPDEIEYIFKPSCVPLMR | GGC | NDEGLE | VPTEESNITMQIMRIKPHQGQHIGEMSFLQHNK | E | |
| Q9BDW8 | grow_factors | 28 | 3 | 32 | 31 | 1 | — | 0 | SRKPLHVDFKELGWDDWILAPLDYEAYH | EGV | DFPLRSHLEPTNHAIIQTLLNSMAPDAAPASC | VPARLSPISILYIDAANNVVYKQYEDMVVEA | G | |
| Q9BDW9 | grow_factors | 28 | 3 | 32 | 31 | 1 | — | 0 | SRKPLHVDFKELGWDDWILAPLDYEAYH | EGV | DFPLRSHLEPTNHAIIQTLLNSMAPDAAPASC | VPARLSPISILYIDAANNVVYKQYEDMVVEA | G | |
| Q9DGN4 | grow_factors | 28 | 3 | 32 | 31 | 1 | — | 0 | SKKPLLVNFKELGWDDWILAPLDYEAYH | EGV | DFPLRSHLEPTNHAIIQTLMNSMDPESTPPSC | VPSKLSPISILYIDSGNNVVYKQYEDMVVES | S | |
| Q9ERL6 | grow_factors | 30 | 3 | 6 | 33 | 1 | — | 0 | HPIETLVDIFQEYPDEIEYIFKPSCVPLMR | GGC | SDEALE | VPTSESNITMQIMRVKPHQSQHIGEMSFLQHSR | E | |
| Q9GK00 | grow_factors | 30 | 3 | 6 | 33 | 1 | — | 0 | HPIETLVDIFQEYPDEIEYIFKPSCVPLMR | GGC | NDEGLE | VPTEEFNITMQIMRIKPHQGQHIGEMSFLQHSK | E | |
| Q9GKR0 | grow_factors | 30 | 3 | 6 | 33 | 1 | — | 0 | RPIETLVDIFQEYPDEIEYIFKPSCVPLMR | GGC | NDEGLE | VPTAEFNITMQIMRIKPHQSQHIGEMSFLQHSK | E | |
| Q9I8T6 | grow_factors | 28 | 3 | 32 | 31 | 1 | — | 0 | KKHELYVSFRDLGWQDWIIAPEGYAAYY | EGE | AFPLNSYMNATNHAIVQTLVHFINPETVPKPC | APTQLNAISVLYFDDSSNVILKKYRNMVVRA | G | |
| Q9MYV3 | grow_factors | 30 | 3 | 6 | 33 | 1 | — | 0 | RPIETLVDIFQEYPDEIEYIFKPSCVPLMR | GGC | NDEGLE | VPTEEFNITMQIMRIKPHQGQHIGEMSFLQHSK | E | |
| Q9MYV3-2 | grow_factors | 30 | 3 | 6 | 33 | 1 | — | 0 | RPIETLVDIFQEYPDEIEYIFKPSCVPLMR | GGC | NDEGLE | VPTEEFNITMQIMRIKPHQGQHIGEMSFLQHSK | E | |
| Q9MYV3-3 | grow_factors | 30 | 3 | 6 | 33 | 1 | — | 0 | RPIETLVDIFQEYPDEIEYIFKPSCVPLMR | GGC | NDEGLE | VPTEEFNITMQIMRIKPHQGQHIGEMSFLQHSK | E | |

TABLE 2-continued

| name | class | Loop 1 length | Loop 2 length | Loop 3 length | Loop 4 length | Loop 5 length | Loop 6 length | # 3D structures | Loop 1 | Loop 2 | Loop 3 | Loop 4 | Loop 5 | Loop 6 |
|---|---|---|---|---|---|---|---|---|---|---|---|---|---|---|
| Q9MZB1 | grow_factors | 30 | 3 | 6 | 33 | 1 | — | 0 | RPIETLVDIFQEYPDEIEFIFKPSCVPLMR | GGC | NDESLE | VPTEEFNITMQIMRIKPHQSQHIGEMSFLQHNK | E | |
| Q9MZV5 | grow_factors | 28 | 3 | 31 | 31 | 1 | — | 0 | RRHSLYVDFSDVGWNDWIVAPPGYQAFY | HGD | PFPLADHLNSTNHAIVQTLVNSVNSSIPKAC | VPTELSAISMLYLDEYDKVVLKNYQEMVVEG | G | |
| Q9PTF9 | grow_factors | 28 | 3 | 32 | 31 | 1 | — | 0 | KKHELYVSFRDLGWQDWIIAPEGYAAFY | EGE | VFPLNSYMNATNHAIVQTLVHFINPETVPKPC | APTQLHGISVLYFDDSSNVILKKYRNMVVRA | G | |
| Q9QX39 | grow_factors | 30 | 3 | 6 | 33 | 1 | — | 0 | HPIETLVDIFQEYPDEIEYIFKPSCVPLMR | GGC | NDEALE | VPTSESNITMQIMRIKPHQSQHIGEMSFLQHNR | E | |
| Q9U418 | grow_factors | 28 | 3 | 32 | 31 | 1 | — | 0 | RRHSLYVDFSDVGWNDWIVAPPGYQAYY | HGE | PFPLADHLNSTNHAIVQTLVNSVNPLAVPKAC | VPTDLSPISMLYLNENDQVVLKNYQDMVVEG | G | |
| Q9U5E8 | grow_factors | 28 | 3 | 32 | 31 | 1 | — | 0 | RRRSLYVDFSDVGWNDWIVAPPGYNAFY | DGE | PFPLADHLNSTNHAIVQTLVHSVKASAVPQAC | VPTELSPISMLYLDEYDKVILKNYQEMVVEG | G | |
| Q9W6C0 | grow_factors | 28 | 3 | 32 | 31 | 1 | — | 0 | SRKPLHVNFKELGWDDWIIAPLDYEAYH | EGL | DFPLRSHLEPTNHAIIQTLMNSMDPESTPPSC | VPSKLSPISILYIDSGNNVVYKQYEDMVVES | G | |
| Q9W6G0 | grow_factors | 28 | 3 | 32 | 31 | 1 | — | 0 | SRKALHVNFKDMGWDDWIIAPLEYEAYH | EGL | EFPLRSHLEPTNHAVIQTLMNSMDPESTPPTC | VPTRLSPISILFIDSANNVVYKQYEDMVVES | G | |
| Q9W753 | grow_factors | 28 | 3 | 32 | 31 | 1 | — | 0 | SKKPLHVNFKELGWDDWIIAPLEYEAHH | EGV | DFPLRSHLEPTNHAIIQTLMNSMNPGSTPPSC | VPTKLTPISILYIDAGNNVVYKQYEDMVVES | G | |
| Q9XS47 | grow_factors | 30 | 3 | 6 | 33 | 1 | — | 0 | RPVERLVDIVSEYPSEMEHLFSPSCVSLMR | TGC | SDESMH | VPLETANVTMQLMKYRSLDQPFFVEMSFSQHVR | E | |
| Q9XYQ7 | grow_factors | 28 | 3 | 32 | 31 | 1 | — | 0 | RRHPLYVDFSDVHWNDWIVAPAGYQAYY | HGE | PFPLAEHLNTTNHAIVQTLVNSVNPALVPKAC | GPTELSAISMLYLDEYEKVVLKNYQDMVVEG | G | |
| Q9XYQ8 | grow_factors | 28 | 3 | 32 | 31 | 1 | — | 0 | RRHELYVDFSDVHWNDWIVAPAGYQAYY | RGE | PFPLAEHLNTTNHAIVQTLVNSVNPALVPKAC | VPTELSAISMLYLDEYEKVVLKNYQDMVVEG | G | |
| Q9ZG69 | grow_factors | 28 | 3 | 32 | 31 | 1 | — | 0 | RRHPLYVDFSDVHWNDWIVAPAGYQAYY | HGE | PFPLAEHLNTTNHAIVQTLVNSVNPALVPKAC | VPTELSAISMLYLDEYEKVVLKNYQDMVVEG | G | |
| Q9YGH7 | grow_factors | 28 | 3 | 32 | 31 | 1 | — | 0 | KKHELYVSFKDLGWQDWIIAPEGYAAFY | EGE | APPLNSYMNATNHAIVQTLVHFINPDTVPKPC | APTQLNAISVLYFDDSSNVILKKYRNMVVRA | G | |
| Q9YGV1 | grow_factors | 28 | 3 | 32 | 31 | 1 | — | 0 | KKRRLYIDFKDVGWQNWVIAPRGYMANY | HGE | PYPLTEMLRGTNHAVLQTLVHSVEPENTPLPC | APTKLSPISMLYYDNNDNVVLRHYEDMVVDE | G | |
| Q9YMF3 | grow_factors | 30 | 3 | 6 | 33 | 1 | — | 0 | KPRPMVFRVHDEHPELTSQRFNPPCVTLMR | GGC | NDESLE | VPTEEANVTMQLMGASVSGGNGMQHLSFVEHKK | D | |

TABLE 2-continued

| name | class | Loop 1 length | Loop 2 length | Loop 3 length | Loop 4 length | Loop 5 length | Loop 6 length | # 3D structures | Loop 1 | Loop 2 | Loop 3 | Loop 4 | Loop 5 | Loop 6 |
|---|---|---|---|---|---|---|---|---|---|---|---|---|---|---|
| GUR_GYMSY | gurmarine | 6 | 6 | 0 | 4 | 9 | — | 2 | VKKDEL | IPYYLD | | EPLE | KKVNWWDHK | |
| ALO1_ACRLO | insect_anti-microbial | 6 | 8 | 0 | 3 | 10 | — | 0 | IKNGNG | QPDGSQGN | | SRY | HKEPGWVAGY | |
| ALO2_ACRLO | insect_anti-microbial | 6 | 8 | 0 | 3 | 10 | — | 0 | IANRNG | QPDGSQGN | | SGY | HKEPGWVAGY | |
| ALO3_ACRLO | insect_anti-microbial | 6 | 8 | 0 | 3 | 10 | — | 1 | IKNGNG | QPNGSQGN | | SGY | HKQPGWVAGY | |
| CVP3_PIMHY | insect_anti-microbial | 6 | 5 | 0 | 4 | 9 | — | 0 | GFPGRR | SPTEE | | EGLV | QPRKNGPSM | |
| CVP5_PIMHY | insect_anti-microbial | 6 | 6 | 0 | 2 | 6 | — | 0 | SSMGAS | QIGSAT | | GV | NVHTLR | |
| Q2MJU0_LYSTE | insect_anti-microbial | 6 | 5 | 0 | 6 | 6 | — | 0 | SPPGFF | QTDDD | | FTKLFR | LEIVGR | |
| Q2PQC7_BEMTA | insect_anti-microbial | 6 | 8 | 0 | 3 | 11 | — | 0 | ISNWTK | KPDGSIGN | | SGY | FQEKPDWEYGI | |
| Q2PQC8_BEMTA | insect_anti-microbial | 6 | 8 | 0 | 3 | 10 | — | 0 | LTKGAS | KGDGSMGN | | SGF | WQANPSSPGS | |
| Q2PQC9_BEMTA | insect_anti-microbial | 6 | 8 | 0 | 3 | 14 | — | 0 | LSDGAA | QSDGSIGN | | SGF | LQYVEPGLHATPGT | |
| Q2PQD0_BEMTA | insect_anti-microbial | 6 | 8 | 0 | 3 | 12 | — | 0 | LPDGAP | QADGSMGN | | TTF | LQHEQPGGTPGH | |
| Q3LTD6_9DIPT | insect_anti-microbial | 6 | 8 | 0 | 3 | 10 | — | 0 | IPDGGR | HESDPGPG | | SGF | YRERNWKDGD | |
| FSPM_SOLLC | metallocarboxy-peptidase_inhibitor | 3 | 5 | 5 | 2 | 13 | — | 0 | NEP | SSNSD | IGITL | QF | KEKTDQYGLTYRT | |
| MCPI_SOLLC | metallocarboxy-peptidase_inhibitor | 3 | 5 | 5 | 2 | 6 | — | 0 | HKP | STQDD | SGGTF | QA | WRFAGT | |
| MCPI_SOLTU | metallocarboxy-peptidase_inhibitor | 3 | 5 | 5 | 2 | 6 | — | 2 | NKP | KTHDD | SGAWF | OA | WNSART | |
| O24372_SOLTU | metallocarboxy-peptidase_inhibitor | 3 | 5 | 5 | 2 | 13 | — | 0 | NDY | NTNAD | LGITL | PW | KLKKSSSGFTYSE | |
| O24373_SOLTU | metallocarboxy-peptidase_inhibitor | 3 | 5 | 5 | 2 | 13 | — | 0 | NDY | TTNAD | FGITL | PW | KLKKSPSGGTYSE | |
| O24639_SOLTU | metallocarboxy-peptidase_inhibitor | 3 | 5 | 5 | 2 | 13 | — | 0 | NDY | TTNAD | IGITF | PW | KLKKSPSGFTYSE | |
| Q3S480_SOLTU | metallocarboxy-peptidase_inhibitor | 3 | 5 | 5 | 2 | 13 | — | 0 | NDY | TRNSD | FGITL | PW | KLKKSPGGGTYSE | |
| Q3S486_SOLTU | metallocarboxy-peptidase_inhibitor | 3 | 5 | 5 | 2 | 13 | — | 0 | NDY | NTNAD | FGLTL | PW | KLKKSSSGFTYSE | |
| Q41432_SOLTU | metallocarboxy-peptidase_inhibitor | 3 | 5 | 5 | 2 | 13 | — | 0 | NDY | NTNAD | FGITL | PW | KLKKSPSGFTYSE | |
| Q948Z8_SOLTU | metallocarboxy-peptidase_inhibitor | 3 | 5 | 5 | 2 | 13 | — | 0 | NDY | TTNAD | FGITL | PW | KLKKSPSGGTYSE | |
| Q949A1_SOLBR | metallocarboxy-peptidase_inhibitor | 3 | 5 | 5 | 2 | 14 | — | 0 | NYY | TSNSD | IGITF | QW | KVKTNPYDGSASRT | |
| Q9SBH8_SOLTU | metallocarboxy-peptidase_inhibitor | 3 | 5 | 5 | 2 | 6 | — | 0 | NKP | KTHDD | SGAWF | OA | WNSART | |
| Q9SXP0_HYONI | metallocarboxy-peptidase_inhibitor | 3 | 5 | 5 | 2 | 11 | — | 0 | FKY | NVESD | SDGWL | YN | VPSAFEGWRSQ | |

TABLE 2-continued

| name | class | Loop 1 length | Loop 2 length | Loop 3 length | Loop 4 length | Loop 5 length | Loop 6 length | # 3D structures | Loop 1 | Loop 2 | Loop 3 | Loop 4 | Loop 5 | Loop 6 |
|---|---|---|---|---|---|---|---|---|---|---|---|---|---|---|
| POL_MUSDO | phenol-oxidase_inhibitor | 6 | 5 | 0 | 3 | 6 | — | 0 | LANGSK | YSHDV | | TKR | HNYAKK | |
| Q170Q5_AEDAE | phenol-oxidase_inhibitor | 6 | 5 | 0 | 3 | 6 | — | 0 | AANGEY | LTHSE | | SGS | LSFSYK | |
| Q170Q6_AEDAE | phenol-oxidase_inhibitor | 6 | 5 | 0 | 3 | 6 | — | 0 | AANGEY | LTHSE | | SGS | LSFSYK | |
| Q5BN34_ANOGA | phenol-oxidase_inhibitor | 6 | 5 | 0 | 3 | 6 | — | 0 | AKNNEY | LTHRD | | SGS | LSFSYK | |
| AMP1_MESCR | plant_anti-microbial | 6 | 8 | 0 | 3 | 10 | — | 0 | IKNGKG | REDQGPPF | | SGF | YRQVGWARGY | |
| AMP1_MIRJA | plant_anti-microbial | 6 | 8 | 0 | 3 | 10 | — | 0 | IGNGGR | NENVGPPY | | SGF | LRQPGQGYGY | |
| AMP2_MIRJA | plant_anti-microbial | 6 | 8 | 0 | 3 | 10 | — | 0 | IGNGGR | NENVGPPY | | SGF | LRQPNQGYGV | |
| PAFP_PHYAM | plant_anti-microbial | 6 | 8 | 0 | 3 | 10 | — | 1 | IKNGGR | NASAGPPY | | SSY | FQIAGQSYGV | |
| Q54AI2_PHYAM | plant_anti-microbial | 6 | 8 | 0 | 3 | 10 | — | 0 | IKNGGR | NASAGPPY | | SSY | FQIAGQSYGV | |
| Q9SDS1_PHYAM | plant_anti-microbial | 6 | 8 | 0 | 3 | 10 | — | 0 | IKNGGR | VASGGPPY | | SNY | LQIAGQSYGV | |
| DEF1_PETHY | plant_defensin | 6 | 5 | 2 | 10 | 6 | — | 1 | PTWDSV | INKKP | VA | CKKAKFSDGH | SKILRR | |
| DEF2_PETHY | plant_defensin | 6 | 5 | 2 | 12 | 6 | — | 0 | PTWEGI | INKAP | VK | CKAQPEKFTDGH | SKILRR | |
| ALB1A_PEA | plant_toxin | 3 | 7 | 4 | 1 | 9 | — | 0 | NGV | SPFEMPP | GTSA | R | IPVGLVVGY | |
| ALB1B_PEA | plant_toxin | 3 | 7 | 4 | 1 | 9 | — | 1 | NGV | SPFEMPP | GSSA | R | IPVGLVVGY | |
| ALB1C_PEA | plant_toxin | 3 | 7 | 4 | 1 | 9 | — | 0 | NGV | SPFDIPP | GSPL | R | IPAGLVIGN | |
| ALB1D_PEA | plant_toxin | 3 | 7 | 4 | 1 | 9 | — | 0 | NGV | SPFEMPP | GTSA | R | IPVGLFIGY | |
| ALB1E_PEA | plant_toxin | 3 | 7 | 4 | 1 | 9 | — | 0 | NGV | SPFEMPP | GSSA | R | IPVGLLIGY | |
| ALB1F_PEA | plant_toxin | 3 | 7 | 4 | 1 | 9 | — | 0 | NGV | SPFEVPP | GTSA | R | IPVGLVIGY | |
| ALB1_GLYSO | plant_toxin | 3 | 7 | 4 | 1 | 9 | — | 0 | NGA | SPFEVPP | RSSD | R | VPIGLFVGF | |
| ALB1_PHAAN | plant_toxin | 3 | 7 | 4 | 1 | 10 | — | 0 | NGA | SPFQMPP | GSTD | L | IPAGLLFVGY | |
| ALB1_PHAAU | plant_toxin | 3 | 7 | 4 | 1 | 9 | — | 0 | NGA | SPFEMPP | RSTD | R | IPIALFGGF | |
| ALB1_SOYBN | plant_toxin | 3 | 7 | 4 | 1 | 9 | — | 1 | NGA | SPFEVPP | RSRD | R | VPIGLFVGF | |
| O24095_MEDTR | plant_toxin | 6 | 7 | 5 | 1 | 11 | — | 0 | PTAGTA | SQRRGNS | GGIE | I | VSQGYPYDGGI | |
| O24100_MEDTR | plant_toxin | 6 | 7 | 5 | 1 | 9 | — | 0 | ARVGMR | SRALPNP | GDIVT | R | VHLHLVGST | |
| O48617_MEDTR | plant_toxin | 6 | 7 | 5 | 1 | 11 | — | 0 | PFAGRV | SQYESNA | GDSEE | I | VSEWSHYDGGI | |
| Q6A1C7_9FABA | plant_toxin | 3 | 7 | 4 | 1 | 9 | — | 0 | NGV | SPFEMPP | GSSD | R | IPVGLVVGY | |
| Q6A1C8_TRIFG | plant_toxin | 3 | 7 | 4 | 1 | 9 | — | 0 | SGI | SSFEMPP | RSSD | R | IPIVLVGGY | |
| Q6A1C9_ONOVI | plant_toxin | 3 | 7 | 4 | 1 | 9 | — | 0 | DGV | SPFEMPP | GSTD | R | VPWGLFVGQ | |
| Q8A1D1_9FABA | plant_toxin | 5 | 7 | 5 | 1 | 9 | — | 0 | NGRDW | SPFEMPP | GDAQN | R | IPWIVGGY | |
| Q6A1D2_MELAB | plant_toxin | 3 | 7 | 4 | 1 | 9 | — | 0 | SGI | SSFEMPP | RSSS | R | IPWLLGGN | |
| Q6A1D3_LONCA | plant_toxin | 5 | 7 | 5 | 1 | 9 | — | 0 | NGRDV | SPFEMPP | DDATN | R | IPWGLWGQ | |
| Q6A1D4_CANBR | plant_toxin | 3 | 7 | 4 | 1 | 9 | — | 0 | SGG | SPFEMPP | GSSD | R | IPWGLVAG | |
| Q6A1D5_9FABA | plant_toxin | 3 | 7 | 4 | 1 | 9 | — | 0 | SGA | FPFQMPP | GSTD | R | VPWGLFVGQ | |

TABLE 2-continued

| name | class | Loop 1 length | Loop 2 length | Loop 3 length | Loop 4 length | Loop 5 length | Loop 6 length | # 3D structures | Loop 1 | Loop 2 | Loop 3 | Loop 4 | Loop 5 | Loop 6 |
|---|---|---|---|---|---|---|---|---|---|---|---|---|---|---|
| Q6AID6_9FABA | plant_toxin | 3 | 7 | 4 | 1 | 9 | — | 0 | SGA | SPFERPL | GSTD | R | IPIVLLAGF | |
| Q6AID7_9FABA | plant_toxin | 3 | 7 | 4 | 1 | 9 | — | 0 | SGV | SPFEMPP | GSTD | R | IPWGLFVGE | |
| Q7XZC2_PHAVU | plant_toxin | 3 | 7 | 5 | 1 | 9 | — | 0 | SGV | SPFERPP | GSTRD | R | IPYGLFIGA | |
| Q7XZC3_SOYBN | plant_toxin | 3 | 7 | 4 | 1 | 9 | — | 0 | NGA | SPFEMPP | RSRD | R | VPIGLVAGF | |
| Q7XZC5_MEDTR | plant_toxin | 3 | 7 | 4 | 1 | 9 | — | 0 | SGA | SPFEMPP | RSSD | R | IPIGIVAGY | |
| SCCT_MESMA | scorpion1 | 2 | 10 | 2 | 6 | 4 | — | 0 | GP | FTTDANMARK | RE | CGGIGK | FGPQ | |
| SCCX_MESMA | scorpion1 | 2 | 10 | 2 | 6 | 4 | — | 0 | GP | FTTDANMARK | RE | CGGNGK | FGPQ | |
| SCIT_MESTA | scorpion1 | 2 | 10 | 2 | 7 | 4 | — | 0 | GP | FTTDPQTQAK | SE | CGRKGGV | KGPQ | |
| SCX1_BUTEU | scorpion1 | 2 | 10 | 2 | 6 | 4 | — | 0 | MP | FTTRPDMAQQ | RA | CKGRGK | FGPQ | |
| SCX1_BUTSI | scorpion1 | 2 | 10 | 2 | 8 | 4 | — | 0 | KP | FTTDPQMSKK | AD | CGGKGKGK | YGPQ | |
| SCX1_LEIQH | scorpion1 | 2 | 10 | 2 | 6 | 4 | — | 0 | GP | FTTDHQMEQK | AE | CGGIGK | YGPQ | |
| SCX3_BUTEU | scorpion1 | 2 | 10 | 2 | 7 | 3 | — | 0 | MP | FTTDHQTARR | RD | CGGRGRK | FGQ | |
| SCX3_MESTA | scorpion1 | 2 | 10 | 2 | 6 | 4 | — | 0 | PP | FTTNPNMEAD | RK | CGGRGY | ASYQ | |
| SCX4_BUTEU | scorpion1 | 2 | 10 | 2 | 6 | 4 | — | 0 | MP | FTTDHNMAKK | RD | CGGNGK | FGPQ | |
| SCX5_BUTEU | scorpion1 | 2 | 10 | 2 | 6 | 4 | — | 1 | MP | FTTDPNMAKK | RD | CGGNGK | FGPQ | |
| SCX8_LEIQH | scorpion1 | 2 | 10 | 2 | 8 | 4 | — | 0 | SP | FTTDQQMTKK | YD | CGGKGKGK | YGPQ | |
| SCXL_BUTSI | scorpion1 | 2 | 10 | 2 | 6 | 4 | — | 0 | GP | FTKDPETEKK | AT | CGGIGR | YGPQ | |
| SCXL_LEIQU | scorpion1 | 2 | 10 | 2 | 8 | 4 | — | 1 | MP | FTTDHQMARK | DD | CGGKGRGK | YGPQ | |
| SCXP_ANDMA | scorpion1 | 2 | 10 | 2 | 6 | 4 | — | 0 | GP | FTTDPYTESK | AT | CGGRGK | VGPQ | |
| SCXS_BUTEU | scorpion1 | 2 | 10 | 2 | 6 | 4 | — | 0 | MP | FTTDPNMANK | RD | CGGGKK | FGPQ | |
| IPTXA_PANIM | scorpion2 | 6 | 5 | 0 | 3 | 10 | — | 1 | LPHLKR | KADND | | GKK | KRRGTNAE KR | |
| SCX1_OPICA | scorpion2 | 6 | 5 | 0 | 3 | 10 | — | 0 | LPHLKR | KENND | | SKK | KRRGTNPE KR | |
| SCX2_OPICA | scorpion2 | 6 | 5 | 0 | 3 | 10 | — | 0 | LPHLKR | KENND | | SKK | KRRGANPE KR | |
| SCXC1_MESMA | scorpion2 | 6 | 5 | 0 | 5 | 8 | — | 0 | NRLNKK | NSDGD | | RYGER | ISTGVNYY | |
| SCXC_SCOMA | scorpion2 | 6 | 5 | 0 | 3 | 10 | — | 1 | LPHLKL | KENKD | | SKK | KRRGTNIEK R | |
| KGX11_CENNO | scorpion3 | 5 | 8 | 2 | 10 | 4 | — | 2 | VDKSR | AKYGYYQE | QD | CKNAGHNGGT | MFFK | |
| KGX12_CENEL | scorpion3 | 5 | 8 | 2 | 10 | 4 | — | 0 | VDKSR | AKYGYYQE | TD | CKKYGHNGGT | MFFK | |
| KGX13_CENGR | scorpion3 | 5 | 8 | 2 | 10 | 4 | — | 0 | VDKSR | AKYGHYQE | TD | CKKYGHNGGT | MFFK | |
| KGX14_CENSC | scorpion3 | 5 | 8 | 2 | 10 | 4 | — | 0 | VDKSR | AKYGYYQE | QD | CKKAGHNGGT | MFFK | |
| KGX15_CENLL | scorpion3 | 5 | 8 | 2 | 10 | 4 | — | 0 | VDKSR | SKYGYYQE | QD | CKKAGHSGGT | MFFK | |
| KGX16_CENEX | scorpion3 | 5 | 8 | 2 | 10 | 4 | — | 0 | VDKSR | AKYGYYQE | QD | CKKAGHKGGT | MFFK | |
| KGX31_CENNO | scorpion3 | 5 | 8 | 2 | 10 | 4 | — | 0 | VNKSR | AKYGYYSQ | EV | CKKAGHRGGT | DFFK | |
| KGX32_CENEL | scorpion3 | 5 | 8 | 2 | 10 | 4 | — | 0 | VDKSR | AKYGYYQQ | EI | CKKAGHRGGT | EFFK | |
| KGX33_CENSC | scorpion3 | 5 | 8 | 2 | 10 | 4 | — | 0 | VDKSR | AKYGYYGQ | EV | CKKAGHRGGT | DFFK | |
| KGX34_CENGR | scorpion3 | 5 | 8 | 2 | 10 | 4 | — | 0 | VDKSR | QKYGNYAQ | TA | CKKAGHNKGT | VYFK | |
| KGX41_CENLL | scorpion3 | 5 | 8 | 2 | 10 | 4 | — | 0 | VDKSK | SKYGYYGQ | DE | CKKAGHNGGT | VYYK | |
| KGX42_CENNO | scorpion3 | 5 | 8 | 2 | 10 | 4 | — | 0 | VDKSK | GKYGYYGQ | QD | CKNAGHNGGT | VYYK | |
| KGX43_CENEX | scorpion3 | 5 | 8 | 2 | 10 | 4 | — | 0 | VDKSR | GKYGYYGQ | DE | CKKAGDRAGI | EYFK | |
| KGX44_CENEX | scorpion3 | 5 | 8 | 2 | 10 | 4 | — | 0 | VDKSR | AKYGYYYY | DE | CKKAGDRAGT | EYFK | |
| KGX45_CENEL | scorpion3 | 5 | 8 | 2 | 10 | 4 | — | 0 | VDKSK | SKYGYYGQ | DK | CKKAGDRAGN | VYFK | |
| KGX46_CENLL | scorpion3 | 5 | 8 | 2 | 10 | 4 | — | 0 | VDKSQ | AKYGYYGQ | DE | CKKAGDRAGN | VYLK | |
| KGX47_CENLL | scorpion3 | 5 | 8 | 2 | 10 | 4 | — | 0 | VDKSK | GKYGYYHQ | DD | CKKAGDRAGT | VYYK | |
| KGX48_CENEL | scorpion3 | 5 | 8 | 2 | 10 | 4 | — | 0 | VDKSR | GKYGYYGQ | DE | CKKAGDRAGI | VYYK | |
| KGX49_CENSC | scorpion3 | 5 | 8 | 2 | 10 | 4 | — | 0 | VDKSR | GKYGYYGQ | DE | CKKAGERVGT | VYYK | |
| KGX4A_CENSC | scorpion3 | 5 | 8 | 2 | 10 | 4 | — | 0 | VDKSR | GKYGYYGQ | DE | CKKAGDRAGI | VYYK | |
| KGX4B_CENNO | scorpion3 | 5 | 8 | 2 | 10 | 4 | — | 0 | VDKSQ | GKYGYYGQ | DE | CKKAGDRAGT | VYYK | |

TABLE 2-continued

| name | class | Loop 1 length | Loop 2 length | Loop 3 length | Loop 4 length | Loop 5 length | Loop 6 length | # 3D structures | Loop 1 | Loop 2 | Loop 3 | Loop 4 | Loop 5 | Loop 6 |
|---|---|---|---|---|---|---|---|---|---|---|---|---|---|---|
| KGX4C_CENSC | scorpion3 | 5 | 8 | 2 | 10 | 4 | — | 0 | VEKSK | GKYGYYGQ | DE | CKKAGDRAGT | VYYK | |
| KGX4D_CENNO | scorpion3 | 5 | 8 | 2 | 10 | 4 | — | 0 | VDKSK | GKYGYYGQ | DE | CKKAGDRAGT | VYYK | |
| KGX51_CENSC | scorpion3 | 5 | 8 | 2 | 10 | 4 | — | 0 | VDKSK | AKYGYYGQ | EV | CKKAGHNGGT | MFFK | |
| KGX52_CENGR | scorpion3 | 5 | 8 | 2 | 10 | 4 | — | 0 | VDKSR | QKYGPYGQ | TD | CKKAGHTGGT | IYFK | |
| A6N2U8_MOMCH | serine_protein-ase_inhib | 6 | 5 | 3 | 1 | 4 | — | 0 | PRIWME | KRDSD | MAQ | I | VDGH | |
| IELI_MOMCH | serine_protein-ase_inhib | 6 | 5 | 3 | 1 | 4 | — | 0 | PLIWME | KRDSD | LAQ | I | VDGH | |
| ITI1_LAGLE | serine_protein-ase_inhib | 6 | 5 | 3 | 1 | 5 | — | 0 | PRIYME | KHDSD | LAD | V | LEHGI | |
| ITI1_CITLA | serine_protein-ase_inhib | 6 | 5 | 3 | 1 | 5 | — | 0 | PRIYME | KRDAD | LAD | V | LQHGI | |
| ITR1_CUCMA | serine_protein-ase_inhib | 6 | 5 | 3 | 1 | 5 | — | 7 | PRILME | KKDSD | LAE | V | LEHGY | |
| ITR1_LUFCY | serine_protein-ase_inhib | 6 | 5 | 3 | 1 | 5 | — | 0 | PRILME | SSDSD | LAE | I | LEQGF | |
| ITR1_MOMCH | serine_protein-ase_inhib | 6 | 5 | 3 | 1 | 5 | — | 0 | PRILKQ | KRDSD | PGE | I | MAHGF | |
| ITR1_MOMCO | serine_protein-ase_inhib | 6 | 5 | 3 | 1 | 5 | — | 0 | PKILQR | RRDSD | PGA | I | RGNGY | |
| ITR1_MOMRE | serine_protein-ase_inhib | 6 | 5 | 3 | 1 | 5 | — | 0 | PRILME | KRDSD | LAQ | V | KRQGY | |
| ITR1_TRIKI | serine_protein-ase_inhib | 6 | 5 | 3 | 1 | 5 | — | 0 | PRILMP | KVNDD | LRG | K | LSNGY | |
| ITR2B_CUCSA | serine_protein-ase_inhib | 6 | 5 | 3 | 1 | 6 | — | 0 | PKILMK | KHDSD | LLD | V | LEDIGY | |
| ITR2_BRYDI | serine_protein-ase_inhib | 6 | 5 | 3 | 1 | 5 | — | 0 | PKILMR | KRDSD | LAG | V | QKNGY | |
| ITR2_ECBEL | serine_protein-ase_inhib | 6 | 5 | 3 | 1 | 5 | — | 7 | PRILMR | KQDSD | LAG | V | GPNGF | |
| ITR2_LUFCY | serine_protein-ase_inhib | 6 | 5 | 3 | 1 | 6 | — | 0 | PRILME | SSDSD | LAE | I | LEQDGF | |
| ITR2_MOMCH | serine_protein-ase_inhib | 6 | 5 | 3 | 1 | 4 | — | 1 | PRIWME | KRDSD | MAQ | I | VDGH | |
| ITR2_MOMCO | serine_protein-ase_inhib | 6 | 5 | 3 | 1 | 5 | — | 3 | PKILKK | RRDSD | PGA | I | RGNGY | |
| ITR2_SECED | serine_protein-ase_inhib | 6 | 5 | 3 | 1 | 5 | — | 0 | PKILMR | KRDSD | LAK | T | QESGY | |
| ITR3_CUCMC | serine_protein-ase_inhib | 6 | 5 | 3 | 1 | 5 | — | 0 | PKILMK | KKDSD | LLD | V | LKEGF | |
| ITR3_CUCPE | serine_protein-ase_inhib | 6 | 5 | 3 | 1 | 5 | — | 2 | PKILME | KKDSD | LAE | I | LEHGY | |
| ITR3_CYCPE | serine_protein-ase_inhib | 6 | 5 | 3 | 1 | 5 | — | 0 | PRILME | KADSD | LAQ | I | EESGF | |
| ITR3_LUFCY | serine_protein-ase_inhib | 6 | 5 | 3 | 1 | 5 | — | 0 | PRILME | SSDSD | LAE | I | LENGF | |
| ITR3_MOMCH | serine_protein-ase_inhib | 6 | 5 | 3 | 1 | 5 | — | 0 | PRILKQ | KQDSD | PGE | I | MAHGF | |
| ITR3_MOMCO | serine_protein-ase_inhib | 6 | 5 | 3 | 1 | 5 | — | 0 | PRILKK | RRDSD | PGE | I | KENGY | |

TABLE 2-continued

| name | class | Loop 1 length | Loop 2 length | Loop 3 length | Loop 4 length | Loop 5 length | Loop 6 length | # 3D structures | Loop 1 | Loop 2 | Loop 3 | Loop 4 | Loop 5 | Loop 6 |
|---|---|---|---|---|---|---|---|---|---|---|---|---|---|---|
| ITR4_CUCMA | serine_protein-ase_inhib | 6 | 5 | 3 | 1 | 5 | — | 0 | PRILMK | KKDSD | LAE | V | LEHGY | |
| ITR4_CUCSA | serine_protein-ase_inhib | 6 | 5 | 3 | 1 | 6 | — | 0 | PRILMK | KHDSD | LPG | V | LEHIEY | |
| ITR4_CYCPE | serine_protein-ase_inhib | 6 | 5 | 3 | 1 | 5 | — | 0 | PRILME | KADSD | LAQ | I | QENGF | |
| ITR4_LUFCY | serine_protein-ase_inhib | 6 | 5 | 3 | 1 | 5 | — | 0 | PRILMP | SSDSD | LAE | I | LENGF | |
| ITR5_CYCPE | serine_protein-ase_inhib | 6 | 5 | 3 | 1 | 5 | — | 0 | PRILME | KADSD | LAQ | I | QESGF | |
| ITR5_LUFCY | serine_protein-ase_inhib | 6 | 5 | 3 | 1 | 5 | — | 0 | PRILMP | KTDDD | MLD | R | LSNGY | |
| ITR5_SECED | serine_protein-ase_inhib | 6 | 5 | 3 | 1 | 5 | — | 0 | PRILMP | KLDTD | FPT | T | RPSGF | |
| ITR6_CYCPE | serine_protein-ase_inhib | 6 | 5 | 3 | 1 | 5 | — | 0 | PRILMK | KKDSD | LAE | I | EEHGF | |
| ITR7_CYCPE | serine_protein-ase_inhib | 6 | 5 | 3 | 1 | 5 | — | 0 | PRILMK | KKDSD | LAE | I | QEHGF | |
| ITRA_MOMCH | serine_protein-ase_inhib | 6 | 5 | 3 | 1 | 4 | — | 1 | PRIWME | TRDSD | MAK | I | VAGH | |
| Q9S8D2_CUCME | serine_protein-ase_inhib | 6 | 5 | 3 | 1 | 5 | — | 0 | PRILMK | KTDRD | LTG | T | KRNGY | |
| Q9S8W2_CUCME | serine_protein-ase_inhib_2 | 6 | 5 | 3 | 1 | 5 | — | 0 | PKILMK | KQDSD | LLD | V | LKEGF | |
| Q9S8W3_CUCME | serine_protein-ase_inhib_2 | 6 | 5 | 3 | 1 | 5 | — | 0 | PKILMK | KQDSD | LLD | V | LKEGF | |
| ITR1_MIRJA | serine_protein-ase_inhib_2 | 6 | 7 | 0 | 3 | 10 | — | 0 | AKTDQI | PPNAPNY | | SGS | VPHPRLRIFV | |
| ITR1_SPIOL | serine_protein-ase_inhib_2 | 6 | 8 | 0 | 3 | 10 | — | 0 | SPSGAI | SGFGPPEQ | | SGA | VPHPILRIFV | |
| ITR2_SPIOL | serine_protein-ase_inhib_2 | 6 | 8 | 0 | 3 | 10 | — | 0 | SPSGAI | SGFGPPEQ | | SGA | VPHPILRIFV | |
| ITR3_SPIOL | serine_protein-ase_inhib_2 | 6 | 8 | 0 | 3 | 10 | — | 0 | SPSGAI | SGFGPPEQ | | SGA | VPHPILRIFV | |
| 29C0_ANCSP | spider | 5 | 4 | 0 | 10 | 9 | — | 0 | TKQAD | AEDE | | LDNLFFKRPY | EMRYGAGKR | |
| A5A3H0_ATRRO | spider | 6 | 5 | 0 | 3 | 13 | — | 0 | IPSGQP | PYNEH | | SGS | TYKENENG NTVQR | |
| A5A3H1_ATRRO | spider | 6 | 5 | 0 | 3 | 13 | — | 0 | TPTGQP | PYNES | | SGS | QEQLNENG HTVKR | |
| A5A3H3_ATRRO | spider | 6 | 5 | 0 | 3 | 13 | — | 0 | IPSGQP | PYNEN | | SQS | TFKENENG NTVKR | |
| A5A3H4_ATRRO | spider | 6 | 5 | 0 | 3 | 13 | — | 0 | IPSGQP | PYNEN | | SKS | TYKENENG NTVQR | |
| A5A3H5_ATRRO | spider | 6 | 5 | 0 | 3 | 13 | — | 0 | IPSGQP | PYNEN | | SQS | TFKENETG NTVKR | |
| A9XDF9_GEOA2 | spider | 6 | 6 | 0 | 4 | 19 | — | 0 | ITWRNS | MHNDKG | | FPWS | VCWSQTVS RNSSRKEK KCQ | |

TABLE 2-continued

| name | class | Loop 1 length | Loop 2 length | Loop 3 length | Loop 4 length | Loop 5 length | Loop 6 length | # 3D structures | Loop 1 | Loop 2 | Loop 3 | Loop 4 | Loop 5 | Loop 6 |
|---|---|---|---|---|---|---|---|---|---|---|---|---|---|---|
| A9XDG0_GEOA2 | spider | 6 | 6 | 0 | 4 | 19 | — | 0 | ITWRNS | MHNDKG | | FPWS | VCWSQTVS RNSSRKEK KCQ | |
| A9XDG1_GEOA2 | spider | 6 | 6 | 0 | 4 | 19 | — | 0 | ITWRNS | MHNDKG | | FPWS | VCWSQTVS RNSSGKEK KCQ | |
| A9XDG2_GEOA2 | spider | 6 | 6 | 0 | 4 | 19 | — | 0 | ITWRNS | MHNDKG | | FPWS | VCWSQTVP RNSSRKEK KCQ | |
| A9XDG3_GEOA2 | spider | 6 | 6 | 0 | 4 | 19 | — | 0 | ITWRNS | MHYDKG | | FPWT | VCWSQTVS RNSSRKEK KCQ | |
| A9XDG4_GEOA2 | spider | 6 | 6 | 0 | 4 | 19 | — | 0 | TTWRNS | MHNDKG | | FPWS | VCWSQTVS RNSSRKEK KCQ | |
| A9XDG5_GEOA2 | spider | 6 | 6 | 0 | 4 | 19 | — | 0 | ITWRNS | VHNDKG | | FPWS | VCWSQTVS RNSSRKEK KCQ | |
| AF1_GRARO | spider | 6 | 5 | 0 | 4 | 3 | — | 0 | QKWLWT | DSERK | | EDMV | RLW | |
| AF2_GRARO | spider | 6 | 5 | 0 | 4 | 3 | — | 0 | QKWMWT | DEERK | | EGLV | RLW | |
| B1P1A0_CHIJI | spider | 6 | 5 | 0 | 4 | 6 | — | 0 | KKMFGG | TVHSD | | AHLG | KPTLKY | |
| B1P1A1_CHIJI | spider | 6 | 6 | 0 | 4 | 6 | — | 0 | GGFWWK | GRGKPP | | KGYA | SKTWGW | |
| B1P1A2_CHIJI | spider | 6 | 5 | 0 | 4 | 7 | — | 0 | RWMFGG | TTDSD | | EHLG | RWEKPSW | |
| B1P1A3_CHIJI | spider | 6 | 6 | 0 | 4 | 6 | — | 0 | GGLMAG | DGKSTF | | SGYN | SPTWKW | |
| B1P1A4_CHIJI | spider | 6 | 6 | 0 | 4 | 6 | — | 0 | GGLMAG | DGKSTF | | SGYN | SPTWKW | |
| B1P1B0_CHIJI | spider | 6 | 5 | 0 | 4 | 9 | — | 0 | IEEGKW | PKKAP | | GRLE | KGPSPKQK K | |
| B1P1B1_CHIJI | spider | 6 | 5 | 0 | 4 | 9 | — | 0 | IEEGKW | PKKAP | | GRLE | KGPSPKQK K | |
| B1P1B2_CHIJI | spider | 6 | 5 | 0 | 4 | 9 | — | 0 | IEEGKW | PKKAP | | GRLE | KGPSPKQK K | |
| B1P1B3_CHIJI | spider | 6 | 5 | 0 | 4 | 9 | — | 0 | FKEGHS | PKTAP | | RPLV | KGPSPNTK K | |
| B1P1B4_CHIJI | spider | 6 | 7 | 0 | 2 | 4 | — | 0 | EPSGKP | RPLMRIP | | GS | VRGK | |
| B1P1B5_CHIJI | spider | 6 | 5 | 0 | 4 | 3 | — | 0 | QKWMWT | DSERK | | EGYV | ELW | |
| B1P1B6_CHIJI | spider | 6 | 5 | 0 | 4 | 3 | — | 0 | QKWMWT | DSERK | | EGYV | ELW | |
| B1P1B7_CHIJI | spider | 6 | 6 | 0 | 4 | 6 | — | 0 | GQFWWK | GEGKPP | | ANFA | KIGLYL | |
| B1P1B8_CHIJI | spider | 6 | 6 | 0 | 4 | 6 | — | 0 | GQFWWK | GEGKPP | | ANFA | KIGLYL | |
| B1P1B9_CHIJI | spider | 6 | 5 | 0 | 4 | 6 | — | 0 | GTMWSP | STEKP | | DNFS | QPAIKW | |
| B1P1C0_CHIJI | spider | 6 | 6 | 0 | 4 | 6 | — | 0 | QKFFWT | HPGQPP | | SGLA | TWPTEI | |
| B1P1C1_CHIJI | spider | 6 | 6 | 0 | 4 | 6 | — | 0 | QKFFWT | HPGQPP | | SGLA | TWPTEI | |
| B1P1C2_CHIJI | spider | 6 | 6 | 0 | 4 | 6 | — | 0 | GGLMAG | GGKSTF | | SGYN | SPTWKW | |
| B1P1C3_CHIJI | spider | 6 | 6 | 0 | 4 | 6 | — | 0 | GGLMDG | DGKSTF | | SGYN | SPTWKW | |
| B1P1C4_CHIJI | spider | 6 | 6 | 0 | 4 | 6 | — | 0 | GGLMDG | DGKSTF | | SGFN | SPTWKW | |
| B1P1C6_CHIJI | spider | 6 | 6 | 0 | 4 | 6 | — | 0 | GGLMDG | DGKSTF | | SGFN | SPTWKW | |
| B1P1C8_CHIJI | spider | 6 | 6 | 0 | 4 | 6 | — | 0 | GEFMWK | GAGKPT | | SGYD | SPTWKW | |
| B1P1C9_CHIJI | spider | 6 | 6 | 0 | 4 | 6 | — | 0 | GEFMWK | GAGKPT | | SGYD | SPTWKW | |
| B1P1D0_CHIJI | spider | 6 | 6 | 0 | 4 | 6 | — | 0 | GEFMWK | GAGKPT | | SGYD | SPTWKW | |
| B1P1D1_CHIJI | spider | 6 | 5 | 0 | 4 | 6 | — | 0 | KGFQVK | KKDSE | | SSYV | GSQWKW | |
| B1P1D2_CHIJI | spider | 6 | 5 | 0 | 4 | 6 | — | 0 | KGFQVK | KKDSE | | SSYV | GSQWKW | |

TABLE 2-continued

| name | class | Loop 1 length | Loop 2 length | Loop 3 length | Loop 4 length | Loop 5 length | Loop 6 length | # 3D structures | Loop 1 | Loop 2 | Loop 3 | Loop 4 | Loop 5 | Loop 6 |
|---|---|---|---|---|---|---|---|---|---|---|---|---|---|---|
| B1P1D3_CHJI | spider | 6 | 5 | 0 | 4 | 6 | — | 0 | KGFQVK | KKDSE | | SSYV | GRQWKW | |
| B1P1D4_CHJI | spider | 6 | 5 | 0 | 4 | 6 | — | 0 | YDIGEL | SSDKP | | SGYY | SPRWGW | |
| B1P1D5_CHJI | spider | 6 | 6 | 0 | 4 | 6 | — | 0 | GGFWWK | GSGKPA | | PKYV | SPKWGL | |
| B1P1D6_CHJI | spider | 6 | 6 | 0 | 4 | 6 | — | 0 | GGFWWK | GSGKPA | | PKYV | SPKWGL | |
| B1P1D7_CHJI | spider | 6 | 5 | 0 | 4 | 6 | — | 0 | RKMFGG | SKHED | | AHLA | KRTFNY | |
| B1P1D8_CHJI | spider | 6 | 5 | 0 | 4 | 6 | — | 0 | RKMFGG | SKHED | | AHLA | KRTFNY | |
| B1P1D9_CHJI | spider | 6 | 5 | 0 | 4 | 6 | — | 0 | RKMFGG | SVDSD | | AHLG | KPTLKY | |
| B1P1E0_CHJI | spider | 6 | 5 | 0 | 4 | 6 | — | 0 | RKMFGG | SVDSD | | AHLG | KPTLKY | |
| B1P1E1_CHJI | spider | 6 | 5 | 0 | 4 | 6 | — | 0 | RKMFGG | SVDSD | | AHLG | KPTLKY | |
| B1P1E2_CHJI | spider | 6 | 5 | 0 | 4 | 6 | — | 0 | RKMFGG | SVDSD | | AHLG | KPTLKY | |
| B1P1E3_CHJI | spider | 6 | 5 | 0 | 4 | 6 | — | 0 | RKMFGG | SVDSD | | AHLG | KPTLKY | |
| B1P1E4_CHJI | spider | 6 | 5 | 0 | 4 | 6 | — | 0 | RKMFGG | SVHSD | | AHLG | KPTLKY | |
| B1P1E5_CHJI | spider | 6 | 5 | 0 | 4 | 5 | — | 0 | GGWMAK | ADSDD | | ETFH | TRFNV | |
| B1P1E6_CHJI | spider | 6 | 5 | 0 | 4 | 5 | — | 0 | GGWMAK | ADSDD | | ETFH | TRFNV | |
| B1P1E7_CHJI | spider | 6 | 5 | 0 | 4 | 5 | — | 0 | GGWMAK | ADSDD | | ETFH | TRFNV | |
| B1P1E8_CHJI | spider | 6 | 5 | 0 | 4 | 5 | — | 0 | GGWMAK | ADSDD | | EAFH | TRFNV | |
| B1P1F0_CHJI | spider | 6 | 6 | 0 | 4 | 5 | — | 0 | RGYGLP | TPEKND | | QRLY | SQHRL | |
| B1P1F1_CHJI | spider | 6 | 6 | 0 | 4 | 6 | — | 0 | LGMFSS | NPDNDK | | EGRK | DRRDQW | |
| B1P1F2_CHJI | spider | 6 | 6 | 0 | 4 | 6 | — | 0 | LGLFSS | NPDNDK | | EGRK | NRRDKW | |
| B1P1F3_CHJI | spider | 6 | 5 | 0 | 4 | 6 | — | 0 | TKFLGG | SEDSE | | PHLG | KDVLYY | |
| B1P1F4_CHJI | spider | 6 | 5 | 0 | 4 | 6 | — | 0 | TKFLGG | SEDSE | | PHLG | KDVLYY | |
| B1P1F5_CHJI | spider | 6 | 5 | 0 | 4 | 6 | — | 0 | TKLLGG | TKDSE | | PHLG | RKKWPYH | |
| B1P1F6_CHJI | spider | 6 | 5 | 0 | 4 | 7 | — | 0 | RYLMGG | SKDGD | | EHLV | RTKWPYH | |
| B1P1F7_CHJI | spider | 6 | 5 | 0 | 4 | 7 | — | 0 | REWLGG | SKDAD | | AHLE | RKKWPYH | |
| B1P1F8_CHJI | spider | 6 | 5 | 0 | 4 | 7 | — | 0 | RALYGG | TKDED | | KHLA | RRTLPTY | |
| B1P1F9_CHJI | spider | 6 | 5 | 0 | 4 | 7 | — | 0 | RALYGG | TKDED | | KHLA | RRTLPTY | |
| B1P1G0_CHJI | spider | 6 | 5 | 0 | 4 | 7 | — | 0 | RWLFGG | EKDSD | | EHLG | RRAKPSW | |
| B1P1G2_CHJI | spider | 6 | 5 | 0 | 4 | 7 | — | 0 | RWLFGG | EKDSD | | EHLG | RRAKPSW | |
| B1P1G3_CHJI | spider | 6 | 5 | 0 | 4 | 7 | — | 0 | RWLFGG | EKDSD | | EHLG | RRAKPSW | |
| B1P1G4_CHJI | spider | 6 | 5 | 0 | 4 | 7 | — | 0 | RWLFGG | EKDSD | | EHLG | RRAKPSW | |
| B1P1G5_CHJI | spider | 6 | 5 | 0 | 4 | 7 | — | 0 | RWLFGG | EKDSD | | EHLG | RRTKPSW | |
| B1P1G6_CHJI | spider | 6 | 5 | 0 | 4 | 7 | — | 0 | RWMFGG | TTDSD | | EHLG | RWEKPSW | |
| B1P1G7_CHJI | spider | 6 | 5 | 0 | 4 | 7 | — | 0 | RWMFGG | TTDSD | | EHLG | RWEKPSW | |
| B1P1G8_CHJI | spider | 6 | 5 | 0 | 4 | 6 | — | 0 | KWYLGD | KAHED | | EHLR | HSRWDW | |
| B1P1G9_CHJI | spider | 6 | 5 | 0 | 4 | 5 | — | 0 | GEKNDR | KTNQD | | SGFR | TKFRR | |
| B1P1H0_CHJI | spider | 6 | 5 | 0 | 4 | 5 | — | 0 | GEKNDR | KTNQD | | SGFR | TKFRR | |
| B1P1H1_CHJI | spider | 6 | 5 | 0 | 4 | 6 | — | 0 | RKMFGG | SVDSD | | AHLG | KPTLKY | |
| B1P1H2_CHJI | spider | 6 | 6 | 0 | 4 | 6 | — | 0 | LGLFWI | NYMDDK | | PGYK | ERSSPW | |
| B1P1H3_CHJI | spider | 6 | 7 | 0 | 4 | 9 | — | 0 | IERMQT | EVEAGLP | | SGAP | ICPYIGDCI | |
| B1P1H4_CHJI | spider | 6 | 7 | 0 | 4 | 9 | — | 0 | IERMQT | EVEAGLP | | SGAP | ICPYIGDCI | |
| B1P1H5_CHJI | spider | 6 | 7 | 0 | 4 | 9 | — | 0 | IERMQT | GVEAGLP | | SGAP | ICPYIGDCI | |
| B1P1H6_CHJI | spider | 6 | 6 | 0 | 4 | 14 | — | 0 | WGANVP | EDENSP | | SPLK | EKTFGYGW WYGSPF | |
| B1P1H7_CHJI | spider | 6 | 6 | 0 | 4 | 14 | — | 0 | WGANVP | EDENSP | | PPLK | EKTFGYGW WYGSPF | |
| B1P1H8_CHJI | spider | 6 | 9 | 0 | 4 | 4 | — | 0 | GHLHDP | PNDRPGHRT | | IGLQ | RYGS | |
| B1P1H9_CHJI | spider | 6 | 5 | 0 | 4 | 7 | — | 0 | RWFWGA | KSDSD | | RYLG | KRKWPNI | |
| B1P1I0_CHJI | spider | 6 | 5 | 0 | 10 | 9 | — | 0 | SRKTWP | ETSED | | DKNCSDTFWT | QLGYGCSR V | |

TABLE 2-continued

| name | class | Loop 1 length | Loop 2 length | Loop 3 length | Loop 4 length | Loop 5 length | Loop 6 length | # 3D structures | Loop 1 | Loop 2 | Loop 3 | Loop 4 | Loop 5 | Loop 6 |
|---|---|---|---|---|---|---|---|---|---|---|---|---|---|---|
| CALA_CALS5 | spider | 6 | 5 | 0 | 3 | 16 | — | 0 | ISARYP | SNSKD | | SGN | | GTFWTCYIR KDPCSKE |
| CALB_CALS5 | spider | 6 | 5 | 0 | 3 | 16 | — | 0 | ISARYP | SNSKD | | SGN | | GTFWTCFIR KDPCSKE |
| CALC_CALS5 | spider | 6 | 5 | 0 | 3 | 16 | — | 0 | ISARYP | SNSKD | | SGS | | GIFWTCYLR KDPCSKE |
| F256_OLIOR | spider | 6 | 5 | 0 | 3 | 8 | — | 0 | TYPGQQ | KSDDE | | HGT | KTAFIGRI | |
| JZT11_CHIJI | spider | 6 | 5 | 0 | 4 | 6 | — | 1 | RKMFGG | SVDSD | | AHLG | KPTLKY | |
| JZT12_CHIJI | spider | 6 | 5 | 0 | 4 | 3 | — | 0 | QKWMWT | DSERK | | EGYV | ELW | |
| JZTX1_CHIJI | spider | 6 | 6 | 0 | 4 | 6 | — | 0 | GQFWWK | GEGKPP | | ANFA | KIGLYL | |
| JZTX3_CHIJI | spider | 6 | 6 | 0 | 4 | 6 | — | 1 | GGFWWK | GRGKPP | | KGYA | SKTWGW | |
| JZTX5_CHIJI | spider | 6 | 5 | 0 | 4 | 3 | — | 0 | QKWMWT | DSKRA | | EGLR | KLW | |
| JZTX7_CHIJI | spider | 6 | 6 | 0 | 4 | 6 | — | 2 | GGLMAG | DGKSTF | | SGYN | SPTWKW | |
| MTX2_GRARO | spider | 6 | 5 | 0 | 4 | 3 | — | 1 | QKWMWT | DEERK | | EGLV | RLW | |
| MTX4_GRARO | spider | 6 | 6 | 0 | 5 | 6 | — | 2 | LEFWVK | NPNDDK | | RPKLK | SKLFKL | |
| Q5Y4U5_AGEOR | spider | 6 | 4 | 0 | 4 | 8 | — | 0 | AEKGIK | HNIH | | SGLT | KCKGSSCV | |
| Q5Y4U6_AGEOR | spider | 6 | 6 | 0 | 4 | 9 | — | 0 | VGENGH | RSWYND | | DGYY | SCMQPPNCI | |
| Q5Y4U7_AGEOR | spider | 6 | 6 | 0 | 4 | 9 | — | 0 | VGENGR | RDWYND | | DGFY | SCRQPPYCI | |
| Q5Y4U8_AGEOR | spider | 6 | 7 | 0 | 4 | 9 | — | 0 | VGENQQ | ADWAGLH | | SGYY | TCRYFPKCI | |
| Q5Y4U9_AGEOR | spider | 6 | 7 | 0 | 4 | 9 | — | 0 | VGENQQ | ADWARPH | | SGYY | TCRYFPKCI | |
| Q5Y4V0_AGEOR | spider | 6 | 7 | 0 | 4 | 9 | — | 0 | VGENQQ | ANWAGPH | | SGYY | TCRYFPKCI | |
| Q5Y4V1_AGEOR | spider | 6 | 7 | 0 | 4 | 9 | — | 0 | VGESQQ | ADWSGPY | | KGYY | TCQYFPKCI | |
| Q5Y4V2_AGEOR | spider | 6 | 7 | 0 | 4 | 9 | — | 0 | VGESQQ | ADWSGPY | | KGYY | TCRYFPKCI | |
| Q5Y4V3_AGEOR | spider | 6 | 7 | 0 | 4 | 9 | — | 0 | VGESQQ | ADWAGPH | | KGYY | TCRYFPKCI | |
| Q5Y4V4_AGEOR | spider | 6 | 7 | 0 | 4 | 9 | — | 0 | VGENQQ | ADWAGPH | | SGYY | TCRYFPKCI | |
| Q5Y4V5_AGEOR | spider | 6 | 7 | 0 | 4 | 9 | — | 0 | VGDGQR | ADWAGPY | | SGYY | SCRSMPYC R | |
| Q5Y4V6_AGEOR | spider | 6 | 7 | 0 | 4 | 9 | — | 0 | VGENQQ | ADWAGPH | | SGYY | TCRYFPKCI | |
| Q5Y4V7_AGEOR | spider | 6 | 7 | 0 | 4 | 9 | — | 0 | VGDGQR | ADWAGPY | | SGYY | SCRSMPYC R | |
| Q5Y4V8_AGEOR | spider | 4 | 5 | 0 | 4 | 9 | — | 0 | AAKNKR | ADWAGPW | | EGLY | SCRSYPGC M | |
| Q5Y4W0_AGEOR | spider | 6 | 5 | 0 | 4 | 10 | — | 0 | THGS | ENGET | | DGWR | RYTGRAVP FM | |
| Q5Y4W1_AGEOR | spider | 6 | 7 | 0 | 4 | 9 | — | 0 | VGENQQ | ADWAGPH | | SGLR | KELSIWDSR | |
| Q5Y4W2_AGEOR | spider | 6 | 7 | 0 | 4 | 9 | — | 0 | LPRNKF | NPSSGPR | | SGLT | KELNIWAN K | |
| Q5Y4W3_AGEOR | spider | 6 | 7 | 0 | 4 | 9 | — | 0 | LPRNKF | NPSSGPR | | SGLT | KELNIWDS R | |
| Q5Y4W4_AGEOR | spider | 6 | 7 | 0 | 4 | 9 | — | 0 | LPRNKF | NPSSGPR | | SGLT | KELNIWAS K | |
| Q5Y4W5_AGEOR | spider | 6 | 7 | 0 | 4 | 9 | — | 0 | LPHNRF | NALSGPR | | SGLT | KELNIWAS K | |
| Q5Y4W6_AGEOR | spider | 6 | 7 | 0 | 4 | 9 | — | 0 | LPHNRF | NALSGPR | | SGLK | KELTIWNT K | |
| Q5Y4W8_AGEOR | spicier | 6 | 7 | 0 | 4 | 9 | — | 0 | LPHNRF | NALTGPR | | SRLR | KELSIWDSI | |
| Q5Y4X0_AGEOR | spider | 6 | 7 | 0 | 4 | 9 | — | 0 | LPHNRF | NALSGPR | | SGLK | KELSIWDSI | |
| Q5Y4X1_AGEOR | spider | 6 | 7 | 0 | 4 | 9 | — | 0 | LPHNRF | NALSGPR | | TGLK | KELSIWDSR | |

TABLE 2-continued

| name | class | Loop 1 length | Loop 2 length | Loop 3 length | Loop 4 length | Loop 5 length | Loop 6 length | # 3D structures | Loop 1 | Loop 2 | Loop 3 | Loop 4 | Loop 5 | Loop 6 |
|---|---|---|---|---|---|---|---|---|---|---|---|---|---|---|
| Q5Y4X2_AGEOR | spider | 6 | 7 | 0 | 4 | 9 | — | 0 | LPHNRF | NALSGPR | | SGLR | KELSIRDSR | |
| Q5Y4X3_AGEOR | spider | 6 | 7 | 0 | 4 | 9 | — | 0 | LPHNRF | NALSGPR | | SGLK | KELSIWDST | |
| Q5Y4X4_AGEOR | spider | 6 | 7 | 0 | 4 | 9 | — | 0 | LPHNRF | NALSDPR | | SGLR | KELSIWDSR | |
| Q5Y4X8_AGEOR | spider | 6 | 7 | 0 | 4 | 9 | — | 0 | LPHNRF | NALSGPR | | SGLR | KELSIWDST | |
| Q5Y4Y0_AGEOR | spider | 6 | 7 | 0 | 4 | 9 | — | 0 | LPHNRF | NALSGPR | | SRLK | KELSIWDSR | |
| Q5Y4Y1_AGEOR | spider | 6 | 7 | 0 | 4 | 9 | — | 0 | LPRNRF | NALSGPR | | SGLR | KELSIWASK | |
| Q5Y4Y2_AGEOR | spider | 6 | 7 | 0 | 4 | 9 | — | 0 | LPHNRF | NALSGPR | | SGLK | KELSIYDSR | |
| Q5Y4Y4_AGEOR | spider | 6 | 7 | 0 | 4 | 9 | — | 0 | LPHNRF | NALSGPR | | SGLR | KELSIWDSR | |
| SFI1_SEGFL | spider | 6 | 7 | 0 | 4 | 17 | — | 0 | MTDGTV | YIHNHND | | GSCL | SNGPIARPW EMMVGNC M | |
| SFI2_SEGFL | spider | 6 | 7 | 0 | 4 | 17 | — | 0 | MADETV | YIHNHNN | | GSCL | LNGPYARP WEMLVGN CK | |
| SFI3_SEGFL | spider | 6 | 7 | 0 | 4 | 17 | — | 0 | MVDGTV | YIHNHND | | GSCL | LNGPIARPW EMMVGNC K | |
| SFI4_SEGFL | spider | 6 | 7 | 0 | 4 | 17 | — | 0 | MVDGTV | YIHNHND | | GSCL | LNGPIARPW KMMVGNC K | |
| SFI5_SEGFL | spider | 6 | 7 | 0 | 4 | 17 | — | 0 | MVDGTV | YIHNHND | | GSCL | PNGPLARP WEMLVGN CK | |
| SFI6_SEGFL | spider | 6 | 7 | 0 | 4 | 17 | — | 0 | MTDETV | YIHNHND | | GSCL | LNGPIARPW EMMVGNC K | |
| SFI7_SEGFL | spider | 6 | 7 | 0 | 4 | 17 | — | 0 | MADGTV | YIHNHND | | GSCL | PNGPLARP WEVLVGNC K | |
| SFI8_SEGFL | spider | 6 | 7 | 0 | 4 | 17 | — | 0 | MADGTV | YIHNHND | | GSCL | PNGPLARP WEMLVGN CK | |
| T244_PHONI | spider | 6 | 5 | 0 | 3 | 8 | — | 0 | RFNGQQ | TSDGQ | | YGK | RTAFLRMI | |
| TACHC_TACTR | spider | 6 | 7 | 0 | 4 | 4 | — | 0 | ATYGQK | RTWSPPN | | WNLR | KAFR | |
| TJT1A_HADFO | spider | 6 | 5 | 0 | 4 | 10 | — | 0 | TGADRP | AACCP | | PGTS | KGPEPNGV SY | |
| TJT1A_HADVE | spider | 6 | 5 | 0 | 4 | 10 | — | 0 | TGADRP | AACCP | | PGTS | QGPESNGV VY | |
| TJT1B_HADVE | spider | 6 | 5 | 0 | 4 | 10 | — | 0 | TGADRP | AACCP | | PGTS | QGPEPNGV SY | |
| TJT1C_HADVE | spider | 6 | 5 | 0 | 4 | 9 | — | 1 | TGADRP | AACCP | | PGTS | KAESNGVS Y | |
| TOG4A_AGEAP | spider | 7 | 6 | 0 | 4 | 10 | — | 3 | IAKDYGR | KWGGTP | | RGRG | ICSIMGTNC E | |
| TOG4B_AGEAP | spider | 7 | 6 | 0 | 4 | 10 | — | 3 | IAEDYGK | TWGGTK | | RGRP | RCSMIGTNC E | |
| TOM1A_MISBR | spider | 6 | 6 | 0 | 10 | 7 | — | 0 | TPSGQP | QPNTQP | | NNAEEQTIN SGS | NGNTVYR TYKENENG | |
| TOT1A_ATRRO | spider | 6 | 5 | 0 | 3 | 13 | — | 0 | IPSGQP | PYNEH | | | NTVQR | |

TABLE 2-continued

| name | class | Loop 1 length | Loop 2 length | Loop 3 length | Loop 4 length | Loop 5 length | Loop 6 length | # 3D structures | Loop 1 | Loop 2 | Loop 3 | Loop 4 | Loop 5 | Loop 6 |
|---|---|---|---|---|---|---|---|---|---|---|---|---|---|---|
| TOT1A_HADIN | spider | 6 | 5 | 0 | 3 | 13 | — | 0 | TPTDQP | PYHES | | SGS | TYKANENG NQVKR | |
| TOT1A_HADVE | spider | 6 | 5 | 0 | 3 | 13 | — | 2 | IPSGQP | PYNEN | | SQS | TFKENENG NTVKR | |
| TOT1B_HADFO | spider | 6 | 5 | 0 | 3 | 13 | — | 0 | IRSGQP | PYNEN | | SQS | TFKTNENG NTVKR | |
| TOT1B_HADIN | spider | 6 | 5 | 0 | 3 | 13 | — | 0 | IPTGQP | PYNEN | | SQS | TYKANENG NQVKR | |
| TOT1B_HADVE | spider | 6 | 5 | 0 | 3 | 13 | — | 0 | IPSGQP | PYNEN | | SQS | TYKENENG NTVKR | |
| TOT1C_HADIN | spider | 6 | 5 | 0 | 3 | 13 | — | 0 | IRTDQP | PYNES | | SGS | TYKANENG NQVKR | |
| TOT1C_HADVE | spider | 6 | 5 | 0 | 3 | 13 | — | 0 | IPSGQP | PYNEN | | SQS | TFKENENG NTVKR | |
| TOT1D_HADVE | spider | 6 | 5 | 0 | 3 | 13 | — | 0 | IPSGQP | PYNEN | | SKS | TYKENENG NTVQR | |
| TOT1E_HADVE | spider | 6 | 5 | 0 | 3 | 13 | — | 0 | IPSGQP | PYNEN | | SQS | TYKENENG NTVKR | |
| TOT1F_HADVE | spider | 6 | 5 | 0 | 3 | 13 | — | 0 | IPSGQP | PYSKY | | SGS | TYKTNENG NSVQR | |
| TOT2A_ATRIL | spider | 5 | 5 | 0 | 5 | 4 | — | 0 | VLSRV | SPDAN | | GLTPI | KMGL | |
| TOT2A_HADIN | spider | 6 | 5 | 0 | 5 | 4 | — | 0 | VVNTLG | SSDKD | | GMTPS | TLGI | |
| TOT2A_HADVE | spider | 6 | 5 | 0 | 5 | 4 | — | 2 | LFGNGR | SSNRD | | ELTPV | KRGS | |
| TOT2B_ATRIL | spider | 5 | 5 | 0 | 5 | 4 | — | 0 | VLSRV | SPDAN | | GLTPI | KMGL | |
| TOT2B_HADIN | spider | 6 | 5 | 0 | 5 | 4 | — | 0 | VLNTLG | SSDKD | | GMTPS | TLGI | |
| TX13_CUPSA | spider | 6 | 6 | 0 | 8 | 14 | — | 0 | TLRNHID | TDDRHS | | RSKMFKDV | TCFYPSQAK KELCT | |
| TX13_PHONI | spider | 6 | 5 | 0 | 3 | 8 | — | 0 | RSNGQQ | TSDGQ | | YGK | MTAFMGKI | |
| TX17_PHORI | spider | 6 | 5 | 0 | 3 | 8 | — | 0 | RFNGQQ | TSDGQ | | NGR | INAFQGRI | |
| TX19_PHOKE | spider | 6 | 4 | 0 | 8 | 8 | — | 0 | ADAWKS | DNLP | | VVNGYSRT | MCSANRCN VCWSQTVS | |
| TX1A_GEOA2 | spider | 6 | 6 | 0 | 4 | 19 | — | 0 | ITWRNS | MHNDKG | | FPWS | RNSSRKEK KCQ | |
| TX1_CERCR | spider | 6 | 6 | 0 | 4 | 6 | — | 0 | LGWFKS | DPKNDK | | KNYT | SRRDRW | |
| TX1_GRARO | spider | 6 | 5 | 0 | 4 | 3 | — | 0 | QKWMWT | DSKRK | | EDMV | QLW | |
| TX1_HETMC | spider | 6 | 5 | 0 | 4 | 6 | — | 0 | RYLFGG | SSTSD | | KHLS | RSDWKY | |
| TX1_PSACA | spider | 6 | 5 | 0 | 4 | 6 | — | 0 | RWFMGG | DSTLD | | KHLS | KMGLYY | |
| TX1_SCOGR | spider | 6 | 5 | 0 | 4 | 6 | — | 1 | RYLFGG | KTTAD | | KHLA | RSDGKY | |
| TX1_STRCF | spider | 6 | 5 | 0 | 4 | 6 | — | 0 | TRMFGA | RRDSD | | PHLG | KPTSKY | |
| TX1_THEBL | spider | 6 | 6 | 0 | 4 | 6 | — | 0 | LGMFES | DPNNDK | | PNRE | NRKHKW | |
| TX21_PHOKE | spider | 6 | 5 | 0 | 3 | 8 | — | 0 | KYNGEQ | TSDGQ | | NGR | RTAFMGKI | |
| TX22_PHOKE | spider | 6 | 6 | 0 | 4 | 13 | — | 0 | IGHRRS | KEDRNG | | KLYT | NCWYPTPD DQWCK | |
| TX22_PHONI | spider | 6 | 5 | 0 | 4 | 9 | — | 0 | PKILKQ | KSDED | | RGWK | FGFSIKDKM | |
| TX24_PHONI | spider | 6 | 5 | 0 | 3 | 8 | — | 0 | RFNGQQ | TSDGQ | | YGK | RTAFMGKI | |
| TX27_PHONI | spider | 6 | 5 | 0 | 4 | 11 | — | 0 | APRFSL | NSDKE | | KGLR | KSRIANMW PTF | |
| TX27_PHORI | spider | 6 | 5 | 0 | 4 | 11 | — | 0 | APRGLL | FRDKE | | KGLT | KGRFVNTW PTF | |
| TX29_PHONI | spider | 5 | 5 | 0 | 4 | 8 | — | 0 | IPFKP | KSDEN | | KKFK | KTTGIVKL | |

TABLE 2-continued

| name | class | Loop 1 length | Loop 2 length | Loop 3 length | Loop 4 length | Loop 5 length | Loop 6 length | # 3D structures | Loop 1 | Loop 2 | Loop 3 | Loop 4 | Loop 5 | Loop 6 |
|---|---|---|---|---|---|---|---|---|---|---|---|---|---|---|
| TX2_CERCR | spider | 6 | 6 | 0 | 4 | 6 | — | 0 | LGWFKS | DPKNDK | | KNYT | SRRDRW | |
| TX2_HETMC | spider | 6 | 5 | 0 | 4 | 10 | — | 0 | RYFWGE | NDEMV | | EHLV | KEKWPITYKI | |
| TX2_PSACA | spider | 6 | 5 | 0 | 4 | 6 | — | 0 | RWFLGG | KSTSD | | EHLS | KMGLDY | |
| TX2_THEBL | spider | 6 | 6 | 0 | 4 | 6 | — | 0 | LGMFSS | DPKNDK | | PNRV | RSRDQW | |
| TX31_PHONI | spider | 6 | 6 | 0 | 4 | 10 | — | 0 | AAVYER | GKGYKR | | EERP | KCNIVMDNCT | |
| TX325_SEGFL | spider | 6 | 10 | 0 | 4 | 20 | — | 0 | IESGKS | THSRSMKNGL | | PKSR | NCRQIQHRHDYLGKRKYSCR | |
| TX32_PHOKE | spider | 6 | 5 | 0 | 4 | 11 | — | 0 | APRGQL | FSDKL | | IGLR | KSRVANMWPTF | |
| TX32_PHONI | spider | 6 | 6 | 0 | 4 | 10 | — | 0 | AGLYKK | GKGASP | | EDRP | KCDLAMGNCI | |
| TX33A_PHONI | spider | 6 | 5 | 0 | 9 | 8 | — | 0 | ADAYKS | NHPRT | | DGYNGYKRA | ICSGSNCK | |
| TX35A_PHONI | spider | 6 | 6 | 0 | 4 | 13 | — | 0 | IGHRRS | KEDRNG | | RLYT | NCWYPTPGDQWCK | |
| TX35_PHONI | spider | 6 | 6 | 0 | 4 | 16 | — | 0 | IGRNES | KFDRHG | | WPWS | SCWNKEGQPESDVWCE | |
| TX37_PHORI | spider | 6 | 6 | 0 | 4 | 10 | — | 0 | AGLYKK | GKGVNT | | ENRP | KCDLAMGNCI | |
| TX3A_PHONI | spider | 6 | 6 | 0 | 4 | 9 | — | 0 | ADVYKE | WYPEKP | | KDRA | QCTLGMTCK | |
| TX3_CERCR | spider | 6 | 5 | 0 | 4 | 6 | — | 0 | RKLLGG | TIDDD | | PHLG | NKKYWH | |
| IX3_LOXIN | spider | 6 | 9 | 0 | 15 | 10 | — | 0 | IKYGDR | GSPHGLPSN | | NDWKYKGRCGCTMGV | TCGPNCPSRG | |
| TX3_PARSR | spider | 6 | 6 | 0 | 5 | 6 | — | 0 | LGFLWK | NPSNDK | | RPNLV | SRKDKW | |
| TX3_PSACA | spider | 6 | 5 | 0 | 4 | 6 | — | 0 | RWYLGG | KEDSE | | EHLQ | HSYWEW | |
| TX3_THEBL | spider | 6 | 6 | 0 | 4 | 6 | — | 0 | LGMFSS | DPNNDK | | PNRV | RVRDQW | |
| TX482_HYSGI | spider | 6 | 5 | 0 | 4 | 9 | — | 0 | RYMFGG | SVNDD | | PRLG | HSLFSY | |
| TX5A_HETVE | spider | 6 | 5 | 0 | 4 | 9 | — | 0 | GWIMDD | TSDSD | | PNWV | SKTGFVKNI | |
| TX5B_HETVE | spider | 6 | 5 | 0 | 4 | 9 | — | 0 | GWLFHS | ESNAD | | ENWA | ATTGRFRYL | |
| TXAG_AGEOP | spider | 6 | 7 | 0 | 4 | 9 | — | 1 | LPHNRF | NALSGPR | | SGLK | KELSIWDSR | |
| TXAG_AGEOR | spider | 6 | 7 | 0 | 4 | 9 | — | 0 | LPHNRF | NALSGPR | | SGLK | KELSIWDSR | |
| TXC1_CUPSA | spider | 6 | 6 | 0 | 8 | 17 | — | 0 | IPKHEE | TNDKHN | | RKGLFKLK | QCSTFDDESGQPTERCA | |
| TXC1_HOLCU | spider | 6 | 6 | 0 | 4 | 9 | — | 0 | VGEYGR | RSAYED | | DGYY | NCSQPPYCL | |
| TXC2_HOLCU | spider | 6 | 7 | 0 | 4 | 9 | — | 0 | VGDGQR | ADWAGPY | | SGYY | SCRSMPYCR | |
| TXC3_HOLCU | spider | 6 | 7 | 0 | 4 | 9 | — | 0 | VGDGQK | ADWFGPY | | SGYY | SCRSMPYCR | |
| TXC5_PHONI | spider | 6 | 4 | 0 | 4 | 8 | — | 0 | AQKGIK | HDIH | | TNLK | VREGSNRV | |
| TXC5_PHORI | spider | 6 | 4 | 0 | 4 | 10 | — | 0 | ADAYKS | DSLK | | NNRI | MCSMIGTNCT | |
| TXC9_CUPSA | spider | 6 | 6 | 0 | 8 | 17 | — | 0 | IPKHHE | TNDKKN | | KKGLTKMK | KCFTVADAKGATSERCA | |
| TXDP1_PARLU | spider | 6 | 7 | 0 | 4 | 9 | — | 1 | LGEGEK | ADWSGPS | | DGFY | SCRSMPYCR | |

TABLE 2-continued

| name | class | Loop 1 length | Loop 2 length | Loop 3 length | Loop 4 length | Loop 5 length | Loop 6 length | # 3D structures | Loop 1 | Loop 2 | Loop 3 | Loop 4 | Loop 5 | Loop 6 |
|---|---|---|---|---|---|---|---|---|---|---|---|---|---|---|
| TXDP2_PARLU | spider | 6 | 7 | 0 | 4 | 9 | — | 1 | VGDGQR | ASWSGPY | | DGYY | SCRSMPYCR | |
| TXDP3_PARLU | spider | 6 | 7 | 0 | 4 | 9 | — | 0 | LNFGDW | ADWSGPS | | GEMW | SCPGFGKCR | |
| TXDP4_PARLU | spider | 6 | 7 | 0 | 4 | 9 | — | 0 | ATKNQR | ASWAGPY | | DGFY | SCRSYPGCM | |
| TXDT1_HADVE | spider | 6 | 5 | 0 | 4 | 10 | — | 1 | AKKRNW | GKTED | | CPMK | VYAWYNEQGS | |
| TXFK1_PSACA | spider | 6 | 8 | 0 | 4 | 4 | — | 1 | GILHDN | VYVPAQNP | | RGLQ | RYGK | |
| TXFK2_PSACA | spider | 6 | 8 | 0 | 2 | 4 | — | 0 | LPAGKT | VRGPMRVP | | GS | SQNK | |
| TXFU5_OLIOR | spider | 6 | 6 | 0 | 4 | 10 | — | 0 | VPVYKE | WYPQKP | | EDRV | QCSFGMTNCK | |
| TXG1D_PLEGU | spider | 6 | 6 | 0 | 4 | 6 | — | 0 | GGFWWK | GSGKPA | | PKYV | SPKWGL | |
| TXG1E_PLEGU | spider | 6 | 6 | 0 | 4 | 6 | — | 0 | GGFWWK | GSGKPA | | PKYV | SPKWGL | |
| TXG2_PLEGU | spider | 6 | 5 | 0 | 4 | 6 | — | 0 | RKMFGG | SVDSD | | AHLG | KPTLKY | |
| TXH10_ORNHU | spider | 6 | 8 | 0 | 2 | 4 | — | 1 | LPPGKP | YGATQKIP | | GV | SHNK | |
| TXH1_ORNHU | spider | 6 | 6 | 0 | 4 | 6 | — | 0 | KGVFDA | TPGKNE | | PNRV | SDKHKW | |
| TXH3_ORNHU | spider | 6 | 4 | 0 | 4 | 6 | — | 0 | AGYMRE | KEKL | | SGYV | SSRWKW | |
| TXH4_ORNHU | spider | 6 | 6 | 0 | 6 | 6 | — | 1 | LEIFKA | NPSNDQ | | KSSKIV | SRKTRW | |
| TXH5_ORNHU | spider | 6 | 5 | 0 | 4 | 6 | — | 0 | RWYLGG | SQDGD | | KHLQ | HSNYEW | |
| TXH9_ORNHU | spider | 6 | 5 | 0 | 4 | 10 | — | 0 | APEGGP | VAGIG | | AGLR | SGAKLGLAGS | |
| TXHA1_SELHA | spider | 6 | 6 | 0 | 4 | 6 | — | 1 | KGFGKS | VPGKNE | | SGYA | NSRDKW | |
| TXHA3_SELHA | spider | 6 | 6 | 0 | 4 | 6 | — | 1 | KGFGDS | TPGKNE | | PNYA | SSKHKW | |
| TXHA4_SELHA | spider | 6 | 6 | 0 | 6 | 6 | — | 3 | LGFGKG | NPSNDQ | | KSSNIV | SRKHRW | |
| TXHA5_SELHA | spider | 6 | 6 | 0 | 6 | 6 | — | 0 | LGFGKG | NPSNDQ | | KSANIV | SRKHRW | |
| TXHN1_GRARO | spider | 6 | 5 | 0 | 4 | 6 | — | 1 | RYLFGG | KTTSD | | KHLG | KFRDKY | |
| TXHN2_GRARO | spider | 6 | 5 | 0 | 4 | 6 | — | 0 | RYLFGG | KTTAD | | KHLG | KFRDKY | |
| TXHP1_HETVE | spider | 6 | 6 | 0 | 4 | 4 | — | 0 | GTTWHY | GTDQSE | | EGWK | SRQL | |
| TXHP2_HETVE | spider | 6 | 5 | 0 | 4 | 4 | — | 1 | GKLFSG | DTNAD | | EGYV | RLW | |
| TXHP3_HETVE | spider | 6 | 5 | 0 | 4 | 3 | — | 0 | GTLFSG | STHAD | | EGFI | KLW | |
| TXI11_DIGCA | spider | 7 | 4 | 0 | 13 | 13 | — | 0 | MKYKSGD | RGKT | | DQQYLWYKWRNLA | RCFTVEVFKKDCW | |
| TXI92_DIGCA | spider | 6 | 4 | 0 | 13 | 13 | — | 0 | KKYDVE | DSGE | | QKQYLWYKWRPLD | RCLKSGFFSSKCV | |
| TXJ1_HETVE | spider | 6 | 5 | 0 | 4 | 3 | — | 0 | GTLFSG | DTSKD | | EGYV | HLW | |
| TXL1_ORNHU | spider | 4 | 5 | 0 | 4 | 6 | — | 1 | LGDK | DYNNG | | SGYV | SRTWKW | |
| TXLT4_LASPA | spider | 6 | 6 | 0 | 4 | 14 | — | 0 | GGVDAP | DKDRPD | | SYAE | LRPSGYGWWHGTYY | |
| TXM10_MACGS | spider | 6 | 6 | 0 | 4 | 10 | — | 0 | LAEYQK | EGSTVP | | PGLS | SAGRFRKTKL | |
| TXM11_MACGS | spider | 6 | 5 | 0 | 4 | 3 | — | 0 | KLTFWR | KKDKE | | GWNI | TGL | |
| TXM31_OLIOR | spider | 6 | 6 | 0 | 4 | 1 | — | 0 | VPVYKE | WYPQKP | | EDRV | Q | |
| TXMG1_AGEAP | spider | 6 | 6 | 0 | 4 | 9 | — | 1 | VPENGH | RDWYDE | | EGFY | SCRQPPKCIVKTSGYW | |
| TXMG1_MACGS | spider | 6 | 5 | 0 | 4 | 13 | — | 0 | MGYDIH | TDRLP | | FGLE | WYKKTY | |
| TXMG2_AGEAP | spider | 6 | 7 | 0 | 4 | 9 | — | 0 | ATKNKR | ADWAGPW | | DGLY | SCRSYPGCM | |
| TXMG2_MACGS | spider | 6 | 5 | 0 | 6 | 13 | — | 0 | MGYDIE | NENLP | | KHRKLE | VETSGYWWYKRKY | |

TABLE 2-continued

| name | class | Loop 1 length | Loop 2 length | Loop 3 length | Loop 4 length | Loop 5 length | Loop 6 length | # 3D structures | Loop 1 | Loop 2 | Loop 3 | Loop 4 | Loop 5 | Loop 6 |
|---|---|---|---|---|---|---|---|---|---|---|---|---|---|---|
| TXMG3_AGEAP | spider | 6 | 7 | 0 | 4 | 9 | — | 0 | VGDGQR | ADWAGPY | | SGYY | SCRSMPYCR | |
| TXMG4_AGEAP | spider | 6 | 7 | 0 | 4 | 9 | — | 0 | VGENQQ | ADWAGPH | | DGYY | TCRYFPKCI | |
| TXMG5_AGEAP | spider | 6 | 7 | 0 | 4 | 9 | — | 0 | VGENKQ | ADWAGPH | | DGYY | TCRYFPKCI | |
| TXMG5_MACGS | spider | 6 | 5 | 0 | 4 | 4 | — | 1 | KLTFWK | KNKKE | | GWNA | ALGI | |
| TXMG6_AGEAP | spider | 6 | 7 | 0 | 4 | 9 | — | 0 | VGESQQ | ADWAGPH | | DGYY | TCRYFPKCI | |
| TXMG6_MACGS | spider | 4 | 9 | 0 | 4 | 9 | — | 0 | VDGS | DPYSSDAPR | | GSQI | QCIFFVPCY | |
| TXMG7_MACGS | spider | 6 | 5 | 0 | 4 | 10 | — | 0 | APEGGP | VVGIG | | KGYS | APGLLGLVGH | |
| TXMG8_MACGS | spider | 6 | 5 | 0 | 4 | 7 | — | 0 | KGLFRQ | KKSSE | | KGSS | ESDLTGL | |
| TXMG9_MACGS | spider | 6 | 4 | 0 | 4 | 10 | — | 0 | GTNGKP | VNGQ | | GALR | VVTYHYADGV | |
| TXP1_PARSR | spider | 6 | 5 | 0 | 4 | 3 | — | 1 | QKWMWT | DSARK | | EGLV | RLW | |
| TXP1_PSACA | spider | 6 | 6 | 0 | 4 | 9 | — | 1 | IPKWKG | VNRHGD | | EGLE | WKRRRSFEV | |
| TXP2_PARSR | spider | 6 | 5 | 0 | 4 | 3 | — | 0 | QKWMWT | DEERK | | EGLV | RLW | |
| TXP3_APTSC | spider | 6 | 5 | 0 | 3 | 15 | — | 0 | NSKGTP | TNADE | | GGK | AYNVWNCIGGGCSKT | |
| TXP5_BRASM | spider | 6 | 5 | 0 | 4 | 6 | — | 0 | VDFQTK | KKDSD | | GKLE | SSRWKW | |
| TXP7_APTSC | spider | 6 | 6 | 0 | 4 | 4 | — | 1 | ARVKEA | GPWEWP | | SGLK | DGSE | |
| TXPR1_THRPR | spider | 6 | 5 | 0 | 4 | 6 | — | 0 | RYWLGG | SAGQT | | KHLV | SRRHGW | |
| TXPR2_THRPR | spider | 6 | 5 | 0 | 4 | 3 | — | 0 | QKWMWT | DSERK | | EGMV | RLW | |
| TXPT6_MACGS | spider | 6 | 5 | 0 | 4 | 13 | — | 0 | MGYDIE | NERLH | | ADLE | VKTSGRWWYKKTY | |
| TXR3_MACRV | spider | 6 | 5 | 0 | 4 | 4 | — | 0 | KLTFWK | KNKKE | | GWNA | ALGI | |
| TXU2_HETVE | spider | 6 | 5 | 0 | 4 | 3 | — | 0 | GGLFSG | DSNAD | | EGYV | RLW | |
| TXVL2_CORVA | spider | 6 | 5 | 0 | 4 | 6 | — | 0 | SRAGEN | YKSGR | | DGLY | KAYVVT | |
| VSTX1_GRARO | spider | 6 | 5 | 0 | 4 | 6 | — | 0 | GKFMWK | KNSND | | KDLV | SSRWKW | |
| VSTX2_GRARO | spider | 6 | 5 | 0 | 4 | 3 | — | 0 | QKWMWT | DEERK | | EGLV | RLW | |
| VSTX3_GRARO | spider | 6 | 6 | 0 | 4 | 6 | — | 0 | LGWFKG | DPDNDK | | EGYK | NRRDKW | |
| WGRTX_GRARO | spider | 6 | 5 | 0 | 4 | 8 | — | 1 | VRFWGK | SQTSD | | PHLA | KSKWPRNI | |
| ASTAE_ASTSM | sponge | 6 | 7 | 0 | 6 | 9 | — | 0 | GLFGDL | TLDGTLA | | IALELE | IPLNDFVGI | |
| AX6A_TERSU | terebra | 3 | 5 | 0 | 4 | 10 | — | 0 | PEY | PHGNE | | EHHE | RYDPWSRELK | |
| A2Q0G4_9VIRU | virus1 | 6 | 8 | 0 | 16 | 7 | — | 0 | TPNYAD | MDLQFNKP | | RQQQLEVGQIIPEDFV | FRFGKGI | |
| A2Q0I8_9VIRU | virus1 | 6 | 8 | 0 | 16 | 7 | — | 0 | IPNYAH | TDIGRTEP | | RQQELRIGQTIPEDFI | FRFGIGK | |
| A2Q0M1_9VIRU | virus1 | 6 | 6 | 0 | 16 | 7 | — | 0 | IPQGSY | MDTVKP | | QPVVLNGFHVRHYERI | FIFGQGL | |
| A2Q0M3_9VIRU | virus1 | 6 | 6 | 0 | 16 | 7 | — | 0 | IPQGSY | MDTVKP | | QPAVLLNRHIRHYERI | FVFGQGL | |
| A2Q0M4_9VIRU | virus1 | 6 | 6 | 0 | 16 | 7 | — | 0 | IPEGSY | LDAIAP | | QPTVLRHGYDRHRENI | FIFGQGL | |
| O11874_CSV | virus1 | 6 | 6 | 0 | 16 | 7 | — | 0 | IDNWKY | RGINKP | | GQQLMEDGTLGPKHFV | FELGQGI | |
| Q5ZNS9_9VIRU | virus1 | 6 | 6 | 0 | 16 | 7 | — | 0 | LKLKSN | DLRSNS | | QESEIGNSSSLVKKIH | DYLGKRV | |
| Q5ZNZ4_9VIRU | virus1 | 6 | 6 | 0 | 17 | 7 | — | 0 | LPLGNP | MKSKLP | | KLTYQNSYLRLGEVPTT | FKFGKGI | |

TABLE 2-continued

| name | class | Loop 1 length | Loop 2 length | Loop 3 length | Loop 4 length | Loop 5 length | Loop 6 length | # 3D structures | Loop 1 | Loop 2 | Loop 3 | Loop 4 | Loop 5 | Loop 6 |
|---|---|---|---|---|---|---|---|---|---|---|---|---|---|---|
| Q66216_CSV | virus1 | 6 | 6 | 0 | 5 | 7 | — | 0 | MANWDY | LGFGKP | | DQHSI | FKFGEGI | |
| Q66236_CSV | virus1 | 6 | 6 | 0 | 5 | 7 | — | 0 | MANWDY | LGFGKP | | DQHSI | FKFGEGI | |
| Q80KH5_CSV | virus1 | 6 | 6 | 0 | 14 | 7 | — | 0 | IGNETN | VHTTLP | | SRYEDGEISPRKFV | WRFGTGI | |
| Q80KH6_CSV | virus1 | 6 | 6 | 0 | 14 | 7 | — | 0 | IVNETN | VHTTLP | | SRYEDGEISPRKFV | WRFGTGI | |
| Q80KH7_CSV | virus1 | 6 | 6 | 0 | 17 | 7 | — | 0 | IKHYHR | RGVSKP | | GQEALPTSGVLVGQEYT | AVFGSGL | |
| Q80KH8_CSV | virus1 | 6 | 6 | 0 | 16 | 7 | — | 0 | IPNWSN | LHTTIP | | HQQSLERGQVLPHDFI | WRFGSGL | |
| Q80KH9_CSV | virus1 | 6 | 6 | 0 | 16 | 7 | — | 0 | LVPSHR | LHTTIP | | HQQSLERGQVLPHDFI | WRFGSGL | |
| Q80PW5_CSV | virus1 | 6 | 6 | 0 | 16 | 7 | — | 0 | IAYNDY | RFSLTP | | DHGLSTQGAWMSEEHT | SVFDSGR | |
| Q80S75_9VIRU | virus1 | 6 | 6 | 0 | 16 | 7 | — | 0 | IGNYQP | IESTKP | | RLEDRTSVRFGREEYI | QRFLGGL | |
| Q89632_CSV | virus1 | 6 | 6 | 0 | 16 | 7 | — | 2 | IGHYQK | VNADKP | | SKTVRYGDSKNVRKFI | DRDGEGV | |
| Q91H14_9VIRU | virus1 | 6 | 6 | 0 | 17 | 7 | — | 0 | IKQFDH | QGMNKP | | GEEAVPQLGIXFGVEFT | SVFDSGV | |
| Q99825_CSV | virus1 | 6 | 6 | 0 | 16 | 7 | — | 0 | IGNYQP | IESTKP | | RLEDRTSVQFGRKEYI | DRFFGGL | |
| A0EYV0_9ABAC | virus2 | 3 | 5 | 7 | 3 | 6 | 5 | 0 | TETGRN | KYSYE | TITALLG | SNA | SAAFGF | YNGIP |
| A8C6C4_NPVAP | virus2 | 3 | 5 | 6 | 3 | 6 | 5 | 0 | TEDGRN | QYSYE | ISAAIG | SGA | SALFKF | YRAIP |
| A9YMX2_9BBAC | virus2 | 3 | 5 | 7 | 3 | 6 | 5 | 0 | TETGRN | VWIP | TVTALLG | SGA | SAVFKY | YNTIP |
| B0FDX4_9ABAC | virus2 | 3 | 5 | 6 | 3 | 6 | 5 | 0 | AETGAV | VWIP | VTIVIG | SGA | SPVFNY | YNGIP |
| CXOL2_NPVOP | virus2 | 3 | 5 | 7 | 3 | 6 | 5 | 0 | TETGRN | VYLP | TVTALLG | SGA | SAAFGF | YNGIP |
| CXOL_NPVAC | virus2 | 3 | 5 | 7 | 3 | 6 | 5 | 0 | AETGAV | VWIP | TVTALLG | SGA | SPIFNY | YNGIP |
| Q06KN7_NPVAG | virus2 | 3 | 5 | 7 | 3 | 6 | 5 | 0 | TETGRN | QYSYE | TVTALLG | SGA | SAVFKY | YNGIP |
| Q0GYM0_9ABAC | virus2 | 3 | 5 | 7 | 3 | 6 | 5 | 0 | AETGAV | VHNDE | TVTALAG | SGA | SPIFNY | YNSIP |
| Q5Y4P1_NPVAP | virus2 | 3 | 5 | 7 | 3 | 6 | 5 | 0 | AETGAV | IHNDE | TITALAG | SGA | SPVFNY | YNSIP |
| Q8JM47_9ABAC | virus2 | 3 | 5 | 7 | 3 | 6 | 5 | 0 | TETGRN | KYSYE | TVTALVG | SGA | SAAFGF | YDGIP |
| Q8QLC7_9ABAC | virus2 | 3 | 5 | 7 | 3 | 6 | 5 | 0 | TDTGRN | KYSYE | TITALLG | SGA | SAAFGF | YHGIP |
| Q9PYR8_GVXN | virus2 | 3 | 5 | 6 | 3 | 6 | 5 | 0 | TETGRN | QYSYE | TITALLG | SGA | SAAFKY | YNGIP |
| Hypa_A | cybase_cyclotide | 3 | 4 | 7 | 1 | 4 | 5 | 0 | AES | VYIP | FTTIIG | S | KNKV | YNGIP |
| circulin_F | cybase_cyclotide | 3 | 4 | 6 | 1 | 4 | 5 | 0 | GES | VWIP | TVTALLIG | S | KNKV | YNGIP |
| cycloviolacin_B16 | cybase_cyclotide | 3 | 4 | 7 | 1 | 4 | 5 | 0 | AES | VWIP | | S | KDKV | YNSIP |
| cycloviolacin_B3 | cybase_cyclotide | 3 | 4 | 6 | 1 | 4 | 5 | 0 | AES | VYLP | | S | KDKV | YNGIP |
| cycloviolacin_B4 | cybase_cyclotide | 3 | 4 | 7 | 1 | 4 | 5 | 0 | AES | VWIP | | S | SNNV | YNGIP |
| cycloviolacin_H4 | cybase_cyclotide | 3 | 4 | 7 | 1 | 4 | 5 | 0 | AES | VYIP | | S | SNRV | YNGIP |
| cycloviolacin_O1 | cybase_cyclotide | 3 | 4 | 7 | 1 | 4 | 5 | 0 | AES | VYIP | | S | KSKV | YNSIP |
| cycloviolacin_O18 | cybase_cyclotide | 3 | 4 | 7 | 1 | 4 | 5 | 0 | GES | VWIP | | K | KSKV | YNSIP |
| cycloviolacin_O7 | cybase_cyclotide | 3 | 4 | 7 | 1 | 4 | 5 | 0 | GES | VYIP | | S | SDKV | YDGIP |
| cycloviolacin_Y5 | cybase_cyclotide | 3 | 4 | 7 | 1 | 4 | 5 | 0 | AES | VYIP | | K | QDKV | YHGIP |
| kalata_B16 | cybase_cyclotide | 3 | 4 | 7 | 1 | 4 | 5 | 0 | AES | VYLP | | K | KDQV | YNGIP |
| kalata_B17 | cybase_cyclotide | 3 | 4 | 6 | 1 | 4 | 5 | 0 | GES | VWIP | | K | SNKV | YHGIP |
| mram_3 | cybase_cyclotide | 3 | 4 | 7 | 1 | 4 | 5 | 0 | AES | VWIP | | K | QGKV | YNGIP |
| vhr1 | cybase_cyclotide | 3 | 4 | 4 | 1 | 4 | 5 | 1 | AES | VYIP | TVTALLIG | S | SNKV | KSAIS |
| vibi_E | cybase_cyclotide | 3 | 4 | 4 | 1 | 4 | 5 | 0 | GET | FKFK | YTPR | G | SYPV | YLNSIS |
| violacin_A | cybase_cyclotide | 3 | 4 | 6 | 1 | 4 | 6 | 0 | GES | VYIP | TVTALVG | T | KDKV | YWNSIS |
| Hyfl_A | cybase_cyclotide | 3 | 4 | 7 | 1 | 4 | 6 | 0 | GET | TTFN | WIPN | K | NHHDKV | |
| Hyfl_F | cybase_cyclotide | 3 | 4 | 4 | 1 | 6 | 6 | 0 | | | | | | |

TABLE 2-continued

| name | class | Loop 1 length | Loop 2 length | Loop 3 length | Loop 4 length | Loop 5 length | Loop 6 length | # 3D structures | Loop 1 | Loop 2 | Loop 3 | Loop 4 | Loop 5 | Loop 6 |
|---|---|---|---|---|---|---|---|---|---|---|---|---|---|---|
| Hyfl_I | cybase_cyclotide | 3 | 4 | 6 | 1 | 4 | 6 | 0 | GES | VFIP | ISGVIG | S | KSKV | YRNGIP |
| Hyfl_J | cybase_cyclotide | 3 | 4 | 4 | 1 | 4 | 6 | 0 | GES | AYFG | WIPG | S | RNKV | YFNGIA |
| Hyfl_K | cybase_cyclotide | 3 | 4 | 6 | 1 | 4 | 6 | 0 | GES | VYIP | FTAVVG | T | KDKV | YLNGTP |
| Hyfl_L | cybase_cyclotide | 3 | 4 | 6 | 1 | 4 | 6 | 0 | AES | VYLP | FTGVIG | T | KDKV | YLNGTP |
| circulin_A | cybase_cyclotide | 3 | 4 | 6 | 1 | 4 | 6 | 0 | GES | VWIP | ISAALG | S | KNKV | YRNGIP |
| circulin_C | cybase_cyclotide | 3 | 4 | 6 | 1 | 4 | 6 | 0 | GES | VFIP | ITSVAG | S | KSKV | YRNGIP |
| circulin_D | cybase_cyclotide | 3 | 4 | 6 | 1 | 4 | 6 | 0 | GES | VWIP | VTSIFN | K | ENKV | YHDKIP |
| circulin_E | cybase_cyclotide | 3 | 4 | 6 | 1 | 4 | 6 | 0 | GES | VWIP | LTSVFN | K | ENKV | YHDKIP |
| cyclopsychotride_A | cybase_cyclotide | 3 | 4 | 7 | 1 | 4 | 6 | 0 | GES | VFIP | TVTALLG | S | KSKV | YKNSIP |
| cycloviolacin_B1 | cybase_cyclotide | 3 | 4 | 6 | 1 | 4 | 6 | 0 | GES | VYLP | FTAPLG | S | SSKV | YRNGIP |
| cycloviolacin_B10 | cybase_cyclotide | 3 | 4 | 6 | 1 | 4 | 6 | 0 | GES | VWIP | LTSAIG | S | KSSV | YRNGV P |
| cycloviolacin_B11 | cybase_cyclotide | 3 | 4 | 6 | 1 | 4 | 6 | 0 | GES | VLIP | ISSVIG | S | KSKV | YRNGIP |
| cycloviolacin_B13 | cybase_cyclotide | 3 | 4 | 6 | 1 | 4 | 6 | 0 | IET | YTFP | ISEMIN | S | KNSR | QKNGA G |
| cycloviolacin_B14 | cybase_cyclotide | 3 | 4 | 6 | 1 | 4 | 6 | 0 | GES | VWIP | ISSAIG | S | KNKV | YRKGIP |
| cycloviolacin_B15 | cybase_cyclotide | 3 | 4 | 6 | 1 | 4 | 6 | 0 | GES | VWIP | ISGAIG | S | KSKV | YRNGIP |
| cycloviolacin_H1 | cybase_cyclotide | 3 | 4 | 6 | 1 | 4 | 6 | 0 | GES | VWIP | LLATIG | S | KSKV | YRNGIP |
| cycloviolacin_O10 | cybase_cyclotide | 3 | 8 | 4 | 1 | 6 | 6 | 0 | GER | VIERTRAW | RTVG | I | SLHTLE | YRNGR L |
| cycloviolacin_O13 | cybase_cyclotide | 3 | 4 | 6 | 1 | 4 | 6 | 0 | GEG | VYLP | FTAPLG | S | SSKV | YRNGIP |
| cycloviolacin_O17 | cybase_cyclotide | 3 | 4 | 6 | 1 | 4 | 6 | 0 | GES | VWIP | LTAAIG | S | SSKV | YRNGIP |
| cycloviolacin_O2 | cybase_cyclotide | 3 | 4 | 6 | 1 | 4 | 6 | 0 | GES | VYIP | LTSAIG | S | KSKV | YRNGIP |
| cycloviolacin_O20 | cybase_cyclotide | 3 | 4 | 6 | 1 | 4 | 6 | 0 | GES | VYIP | LTSAVG | S | KNKV | YRNGIP |
| cycloviolacin_O25 | cybase_cyclotide | 3 | 4 | 6 | 1 | 4 | 6 | 0 | GES | VWIP | ISAAIG | S | KSKV | YRNGIP |
| cycloviolacin_O3 | cybase_cyclotide | 3 | 4 | 6 | 1 | 4 | 6 | 0 | GES | VWIP | ISSAIG | S | KSKV | YRDGIP |
| cycloviolacin_O4 | cybase_cyclotide | 3 | 4 | 7 | 1 | 4 | 6 | 0 | GET | AFIP | ITHVPGT | S | KSKV | YFNDIF |
| cycloviolacin_O5 | cybase_cyclotide | 3 | 4 | 6 | 1 | 4 | 6 | 0 | GES | VWIP | LTSAIG | S | KSKV | YRNGIP |
| cycloviolacin_O9 | cybase_cyclotide | 3 | 4 | 6 | 1 | 4 | 6 | 0 | GES | VWIP | ISSAIG | S | KNKV | YRNGIP |
| cycloviolacin_Y4 | cybase_cyclotide | 3 | 4 | 6 | 1 | 4 | 6 | 0 | GES | VWIP | ISSAVG | S | KNKV | YKNGT P |
| cycloviolin_B | cybase_cyclotide | 3 | 4 | 6 | 1 | 4 | 6 | 0 | GES | VWIP | LTSAVG | S | KSKV | YRNGV |
| cycloviolin_C | cybase_cyclotide | 3 | 4 | 4 | 1 | 4 | 6 | 0 | GES | VFIP | ITGVIG | S | SSNV | YLNGV P |
| cycloviolin_D | cybase_cyclotide | 3 | 4 | 4 | 1 | 4 | 6 | 0 | GES | YVLP | FTVG | T | TSSQ | FKNGT A |
| hcf-1 | cybase_cyclotide | 3 | 4 | 6 | 1 | 4 | 6 | 0 | GES | VFIP | LTTVAG | S | KNKV | YRNGIP |
| htf-1 | cybase_cyclotide | 3 | 4 | 6 | 1 | 4 | 6 | 0 | GES | VFIP | ISAAIG | S | KNKV | YRNGFP |
| kalata_B12 | cybase_cyclotide | 3 | 4 | 6 | 1 | 4 | 6 | 0 | GES | HYIP | VTSAIG | S | RNRS | MRNGIP |
| kalata_B18 | cybase_cyclotide | 3 | 4 | 4 | 1 | 4 | 6 | 0 | GDS | HYIP | VTSTIG | S | TNGS | MRNGIP |
| kalata_B5 | cybase_cyclotide | 3 | 4 | 4 | 1 | 4 | 6 | 0 | GDT | FVLG | NDSS | S | NYPI | VKDGS L |
| mram_2 | cybase_cyclotide | 3 | 4 | 6 | 1 | 4 | 6 | 0 | AES | VYIP | ISTVLG | S | SNQV | YRNGV P |
| | cybase_cyclotide | 3 | 4 | 6 | 1 | 4 | 6 | 0 | GES | VYIP | ISGVIG | S | TDKV | YLNGTP |
| | cybase_cyclotide | 3 | 4 | 6 | 1 | 4 | 6 | 0 | AES | VYIP | LTSAIG | S | KSKV | YRNGIP |

TABLE 2-continued

| name | class | Loop 1 length | Loop 2 length | Loop 3 length | Loop 4 length | Loop 5 length | Loop 6 length | # 3D structures | Loop 1 | Loop 2 | Loop 3 | Loop 4 | Loop 5 | Loop 6 |
|---|---|---|---|---|---|---|---|---|---|---|---|---|---|---|
| mram_8 | cybase_cyclotide | 3 | 4 | 6 | 1 | 4 | 6 | 0 | GES | VFIP | LTSAIG | S | KSKV | YRNGIP |
| mram_9 | cybase_cyclotide | 3 | 4 | 6 | 1 | 4 | 6 | 0 | GES | VWIP | LTSIVG | S | KNNV | TLNGVP |
| vhl_1 | cybase_cyclotide | 3 | 5 | 6 | 1 | 4 | 6 | 1 | GES | AMISF | FTEVIG | S | KNKV | YLNSIS |
| vibi_I | cybase_cyclotide | 3 | 4 | 6 | 1 | 4 | 6 | 0 | GES | VWIP | LTSTVG | S | KSKV | YRNGIP |
| vibi_K | cybase_cyclotide | 3 | 4 | 6 | 1 | 4 | 6 | 0 | GES | VWIP | LTSAVG | P | KSKV | YRNGIP |
| vitri_A | cybase_cyclotide | 3 | 4 | 6 | 1 | 4 | 6 | 0 | GES | VWIP | ITSAIG | S | KSKV | YRNGIP |
| Hyfl_D | cybase_cyclotide | 3 | 4 | 6 | 1 | 4 | 7 | 0 | GES | VYIP | FTGIAG | S | KSKV | YYNGSVP |
| Hyfl_E | cybase_cyclotide | 3 | 4 | 4 | 1 | 4 | 7 | 0 | GES | VYLP | FLPN | Y | RNHV | YLNGEIP |
| Hyfl_M | cybase_cyclotide | 3 | 4 | 4 | 1 | 4 | 7 | 0 | GES | IFFP | FNPG | S | KDNL | YYNGNIP |
| PS-1 | cybase_cyclotide | 3 | 5 | 4 | 1 | 5 | 7 | 0 | GET | IWDKT | HAAG | S | SVANI | VRNGFIP |
| circulin_B | cybase_cyclotide | 3 | 4 | 6 | 1 | 4 | 7 | 0 | GES | VFIP | ISTLLG | S | KNKV | YRNGVIP |
| cycloviolacin_B12 | cybase_cyclotide | 3 | 4 | 6 | 1 | 4 | 7 | 0 | GES | VFIP | ISSVIG | S | KSKV | YRNGVIP |
| cycloviolacin_B17 | cybase_cyclotide | 3 | 4 | 4 | 1 | 4 | 7 | 0 | GET | TLGT | YTVG | T | SWPI | TRNGLPI |
| cycloviolacin_B6 | cybase_cyclotide | 3 | 4 | 4 | 1 | 4 | 7 | 0 | GET | VGGT | NTPG | G | SWPV | TRNGLPV |
| cycloviolacin_B7 | cybase_cyclotide | 3 | 4 | 4 | 1 | 4 | 7 | 0 | GET | VGGT | NTPG | A | SWPV | TRNGLPV |
| cycloviolacin_H2 | cybase_cyclotide | 3 | 4 | 4 | 1 | 4 | 7 | 0 | GES | VYIP | FIPG | S | RNRV | YLNSAIA |
| cycloviolacin_H3 | cybase_cyclotide | 3 | 4 | 4 | 1 | 5 | 7 | 0 | GET | FGGT | NTPG | I | DPWPV | TRNGLPV |
| cycloviolacin_O11 | cybase_cyclotide | 3 | 4 | 6 | 1 | 4 | 7 | 0 | GES | VWIP | ISAVVG | S | KSKV | YKNGTLP |
| cycloviolacin_O12 | cybase_cyclotide | 3 | 4 | 4 | 1 | 4 | 7 | 0 | GET | VGGT | NTPG | S | SWPV | TRNGLPI |
| cycloviolacin_O15 | cybase_cyclotide | 3 | 4 | 4 | 1 | 4 | 7 | 0 | GET | FTGK | YTPG | S | SYPI | KKNGLVP |
| cycloviolacin_O16 | cybase_cyclotide | 3 | 4 | 4 | 1 | 4 | 7 | 0 | GET | FTGK | YTPG | S | SYPI | KKINGLP |
| cycloviolacin_O19 | cybase_cyclotide | 3 | 4 | 6 | 1 | 4 | 7 | 0 | GES | VWIP | ISSWG | S | KSKV | YKDGTLP |
| cycloviolacin_O21 | cybase_cyclotide | 3 | 4 | 4 | 1 | 4 | 7 | 0 | GET | VTGS | YTPG | T | SWPV | TRNGLPV |
| cycloviolacin_O22 | cybase_cyclotide | 3 | 4 | 4 | 1 | 4 | 7 | 0 | GET | VGGT | NTPG | T | SWPV | TRNGLPI |
| cycloviolacin_O23 | cybase_cyclotide | 3 | 4 | 4 | 1 | 6 | 7 | 0 | GET | FGGT | NTPG | T | DSSWPI | THNGLPT |

TABLE 2-continued

| name | class | Loop 1 length | Loop 2 length | Loop 3 length | Loop 4 length | Loop 5 length | Loop 6 length | # 3D structures | Loop 1 | Loop 2 | Loop 3 | Loop 4 | Loop 5 | Loop 6 |
|---|---|---|---|---|---|---|---|---|---|---|---|---|---|---|
| cycloviolacin_O24 | cybase_cyclotide | 3 | 4 | 4 | 1 | 5 | 7 | 0 | GET | FGGT | NTPG | T | DPWPV | THNGLPT |
| cycloviolacin_O6 | cybase_cyclotide | 3 | 4 | 6 | 1 | 4 | 7 | 0 | GES | VWIP | ISAAVG | S | KSKV | YKNGTLP |
| cycloviolacin_O8 | cybase_cyclotide | 3 | 4 | 6 | 1 | 4 | 7 | 0 | GES | VWIP | ISSVVG | S | KSKV | YKNGTLP |
| cycloviolin_A | cybase_cyclotide | 3 | 4 | 6 | 1 | 4 | 7 | 0 | GES | VFIP | ISAAIG | S | KNKV | YRNGVIP |
| kalata_B1 | cybase_cyclotide | 3 | 4 | 4 | 1 | 4 | 7 | 0 | GET | VGGT | NTPG | T | SWPV | TRNGLPV |
| kalata_B10 | cybase_cyclotide | 3 | 4 | 4 | 1 | 5 | 7 | 0 | GET | FGGT | NTPG | S | SSWPI | TRDGLPT |
| kalata_B10 linear | cybase_cyclotide | 3 | 4 | 4 | 1 | 5 | 7 | 0 | GET | FGGT | NTPG | S | SSWPI | TRDGLPT |
| kalata_B11 | cybase_cyclotide | 3 | 4 | 4 | 1 | 4 | 7 | 0 | GET | FGGT | NTPG | S | TDPI | TRDGLPV |
| kalata_B13 | cybase_cyclotide | 3 | 4 | 4 | 1 | 5 | 7 | 0 | GET | FGGT | NTPG | A | DPWPV | TRDGLPV |
| kalata_B14 | cybase_cyclotide | 3 | 4 | 4 | 1 | 5 | 7 | 0 | GES | FGGT | NTPG | A | DPWPV | TRDGLPV |
| kalata_B15 | cybase_cyclotide | 3 | 4 | 4 | 1 | 4 | 7 | 0 | GES | FGGS | YTPG | S | TWPI | TRDGLPV |
| kalata_B2 | cybase_cyclotide | 3 | 4 | 4 | 1 | 4 | 7 | 0 | GET | FGGT | NTPG | S | TWPI | TRDGLPV |
| kalata_B3 | cybase_cyclotide | 3 | 4 | 4 | 1 | 5 | 7 | 0 | GET | FGGT | NTPG | S | DPWPI | TRDGLPT |
| kalata_B4 | cybase_cyclotide | 3 | 4 | 4 | 1 | 4 | 7 | 0 | GET | VGGT | NTPG | T | SWPV | TRDGLPV |
| kalata_B6 | cybase_cyclotide | 3 | 4 | 4 | 1 | 5 | 7 | 0 | GET | FGGT | NTPG | S | SSWPI | TRNGLPT |
| kalata_B7 | cybase_cyclotide | 3 | 4 | 4 | 1 | 4 | 7 | 0 | GET | TLGT | YTQG | T | SWPI | KRNGLPV |
| kalata_S | cybase_cyclotide | 3 | 4 | 4 | 1 | 4 | 7 | 0 | GET | VGGT | NTPG | S | SWPV | TRNGLPV |
| mram_1 | cybase_cyclotide | 3 | 4 | 6 | 1 | 4 | 7 | 0 | GES | VYIP | ISSLLG | S | KSKV | YKNGSIP |
| mram_10 | cybase_cyclotide | 3 | 4 | 6 |   | 4 | 7 | 0 | GES | VFIP | ISSVLG | S | KNKV | YRNGVIP |

TABLE 2-continued

| name | class | Loop 1 length | Loop 2 length | Loop 3 length | Loop 4 length | Loop 5 length | Loop 6 length | # 3D structures | Loop 1 | Loop 2 | Loop 3 | Loop 4 | Loop 5 | Loop 6 |
|---|---|---|---|---|---|---|---|---|---|---|---|---|---|---|
| mram_11 | cybase_cyclotide | 3 | 4 | 4 | 1 | 4 | 7 | 0 | GET | LLGT | YTPG | T | KRPV | YKNGHPT |
| mram_13 | cybase_cyclotide | 3 | 4 | 4 | 1 | 4 | 7 | 0 | GET | VGNK | YTPG | T | TWPV | YRNGHPI |
| mram_14 | cybase_cyclotide | 3 | 4 | 6 | 1 | 4 | 7 | 0 | GEG | VFIP | ISSIVG | S | KSKV | YKNGSIP |
| mram_4 | cybase_cyclotide | 3 | 4 | 6 | 1 | 4 | 7 | 0 | GES | VFIP | ISSVVG | S | KNKV | YKNGSIP |
| mram_5 | cybase_cyclotide | 3 | 4 | 6 | 1 | 4 | 7 | 0 | GES | VFIP | LTSAIG | S | KSKV | YKNGTIP |
| mram_6 | cybase_cyclotide | 3 | 4 | 6 | 1 | 4 | 7 | 0 | GES | VYIP | ISSLLG | S | ESKV | YKNGSIP |
| mram_7 | cybase_cyclotide | 3 | 4 | 4 | 1 | 4 | 7 | 0 | GES | VFIP | ISSIVG | S | KSKV | YKNGSIP |
| varv_peptide_A | cybase_cyclotide | 3 | 4 | 4 | 1 | 4 | 7 | 0 | GET | VGGT | NTPG | S | SWPV | TRNGLPV |
| varv_peptide_B | cybase_cyclotide | 3 | 4 | 4 | 1 | 5 | 7 | 0 | GET | FGGT | NTPG | S | DPWPM | SRNGLPV |
| varv_peptide_C | cybase_cyclotide | 3 | 4 | 4 | 1 | 4 | 7 | 0 | GET | VGGT | NTPG | S | SWPV | TRNGVPI |
| varv_peptide_D | cybase_cyclotide | 3 | 4 | 4 | 1 | 4 | 7 | 0 | GET | VGGS | NTPG | S | SWPV | TRNGLPI |
| varv_peptide_E | cybase_cyclotide | 3 | 4 | 4 | 1 | 4 | 7 | 0 | GET | VGGT | NTPG | S | SWPV | TRNGLPI |
| varv_peptide_F | cybase_cyclotide | 3 | 4 | 4 | 1 | 4 | 7 | 0 | GET | TLGT | YTAG | S | SWPV | TRNGVPI |
| varv_peptide_G | cybase_cyclotide | 3 | 4 | 4 | 1 | 5 | 7 | 0 | GET | FGGT | NTPG | S | DPWPV | SRNGVP |
| varv_peptide_H | cybase_cyclotide | 3 | 4 | 4 | 1 | 5 | 7 | 0 | GET | FGGT | NTPG | S | ETWPV | SRNGLPV |
| vhl_2 | cybase_cyclotide | 3 | 4 | 4 | 1 | 5 | 7 | 0 | GET | FTGT | YTNG | T | DPWPV | TRNGLPV |
| vibi_A | cybase_cyclotide | 3 | 4 | 4 | 1 | 4 | 7 | 0 | GET | FGGT | NTPG | S | SYPI | TRNGLPV |
| vibi_B | cybase_cyclotide | 3 | 4 | 4 | 1 | 4 | 7 | 0 | GET | FGGT | NTPG | T | SYPI | TRNGLPV |
| vibi_C | cybase_cyclotide | 3 | 4 | 4 | 1 | 4 | 7 | 0 | GET | AFGS | YTPG | S | SWPV | TRNGLPV |
| vibi_D | cybase_cyclotide | 3 | 4 | 4 | 1 | 4 | 7 | 0 | GET | FGGR | NTPG | T | SYPI | TRNGLPV |
| vibi_F | cybase_cyclotide | 3 | 4 | 6 | 1 | 4 | 7 | 0 | GES | VFIP | LTSALG | S | KSKV | YKNGTIP |
| vibi_G | cybase_cyclotide | 3 | 4 | 6 | 1 | 4 | 7 | 0 | GES | VFIP | LTSAIG | S | KSKV | YKNGTFP |
| vibi_H | cybase_cyclotide | 3 | 4 | 6 | 1 | 4 | 7 | 0 | AES | VYIP | LTTVIG | S | KSKV | YKNGLLP |
| vibi_J | cybase_cyclotide | 3 | 4 | 6 | 1 | 4 | 7 | 0 | GES | VWIP | ISKVIG | A | KSKV | YKNGTFP |
| vico_A | cybase_cyclotide | 3 | 4 | 6 | 1 | 4 | 7 | 0 | AES | VYIP | FTGIAG | S | KNKV | YYNGSIP |

TABLE 2-continued

| name | class | Loop 1 length | Loop 2 length | Loop 3 length | Loop 4 length | Loop 5 length | Loop 6 length | # 3D structures | Loop 1 | Loop 2 | Loop 3 | Loop 4 | Loop 5 | Loop 6 |
|---|---|---|---|---|---|---|---|---|---|---|---|---|---|---|
| vico_B | cybase_cyclotide | 3 | 4 | 6 | 1 | 4 | 7 | 0 | AES | VYIP | ITGIAG | S | KNKV | YYNGSIP |
| violapeptide_1 | cybase_cyclotide | 3 | 4 | 4 | 1 | 4 | 7 | 0 | GET | VGGT | NTPG | S | SRPV | TXNGLPV |
| vodo_M | cybase_cyclotide | 3 | 4 | 4 | 1 | 4 | 7 | 0 | GES | FTGK | YTVQ | S | SWPV | TRNGAPI |
| vodo_N | cybase_cyclotide | 3 | 4 | 4 | 1 | 4 | 7 | 0 | GET | TLGK | YTAG | S | SWPV | YRNGLPV |
| CD-1 | cybase_cyclotide | 3 | 4 | 6 | 1 | 6 | 8 | 0 | GES | YVIP | ISYLVG | S | DITEKV | KRNGADGF |
| Hyfl_B | cybase_cyclotide | 3 | 4 | 6 | 1 | 4 | 8 | 0 | AET | FIGK | YTEELG | T | TAFL | MKNGSPIQ |
| Hyfl_C | cybase_cyclotide | 3 | 4 | 6 | 1 | 4 | 8 | 0 | AET | FIGK | YTEELG | T | TAFL | MKNGSPRQ |
| cycloviolacin_O14 | cybase_cyclotide | 3 | 4 | 4 | 1 | 5 | 8 | 0 | GES | FKGK | YTPG | S | SKYPL | AKNGSIPA |
| kalata_B8 | cybase_cyclotide | 3 | 4 | 4 | 1 | 5 | 8 | 0 | GET | LLGT | YTTG | T | NKYRV | TKDGSVLN |
| kalata_B9 | cybase_cyclotide | 3 | 4 | 4 | 1 | 5 | 8 | 0 | GET | VLGT | YTPG | T | NTYRV | TKDGSVFN |
| kalata_B9_linear | cybase_cyclotide | 3 | 4 | 4 | 1 | 5 | 8 | 0 | GET | VLGT | YTPG | T | NTYRV | TKDGSVFN |
| mram_12 | cybase_cyclotide | 3 | 5 | 4 | 1 | 4 | 8 | 0 | GES | TLGE | YTPG | T | SWPI | TKNGSAIL |
| palicourein | cybase_cyclotide | 3 | 4 | 7 | 1 | 7 | 8 | 1 | GET | RVIPV | TYSAALG | T | DDRSDGL | KRNGDPTF |
| cycloviolacin_Y1 | cybase_cyclotide | 3 | 4 | 4 | 1 | 5 | 10 | 0 | GET | FLGT | YTPG | S | GNYGF | YGTNGGTIFD |
| cycloviolacin_Y2 | cybase_cyclotide | 3 | 4 | 4 | 1 | 5 | 10 | 0 | GES | FLGT | YTAG | S | GNWGL | YGTNGGTIFD |
| cycloviolacin_Y3 | cybase_cyclotide | 3 | 4 | 4 | 1 | 5 | 10 | 0 | GET | FLGT | YTAG | S | GNWGL | YGTNGGTIFD |
| tricyclon_A | cybase_cyclotide | 3 | 4 | 4 | 1 | 5 | 10 | 0 | GES | FLGT | YTKG | S | GEWKL | YGTNGGTIFD |
| tricyclon_B | cybase_cyclotide | 3 | 4 | 4 | 1 | 5 | 10 | 0 | GES | FLGT | YTKG | S | GEWKL | YGENGGTIFD |

SEQUENCE LISTING (6935 sequences)

SEQ ID NO: 1 - protein, 31 aa, Clitoria ternatea
SCVWIPCTVTALLGCSCKDKVCYLNGVPCAE

SEQ ID NO: 2 - protein, 18 aa, Clitoria ternatea
SCVWIPCTVTALLGCSCK

SEQ ID NO: 3 - protein, 13 aa, Clitoria ternatea
DKVCYLNGVPCAE

SEQ ID NO: 4 - protein, 29 aa, Oldenlandia affinis
GLPVCGETCVGGTCNTPGCTCSWPVCTRN

SEQ ID NO: 5 - protein, 30 aa, Viola odorata
GIPCGESCVWIPCISSAIGCSCKSKVCYRN

SEQ ID NO: 6 - protein, 34 aa, Momordica cochinchinensis
GGVCPKILKKCRRDSDCPGACICRGNGYCGSGSD

SEQ ID NO: 7 - protein, 31 aa, Clitoria ternatea
GVIPCGESCVFIPCISTVIGCSCKNKVCYRN

SEQ ID NO: 8 - protein, 31 aa, Clitoria ternatea
GVPCAESCVWIPCTVTALLGCSCKDKVCYLN

SEQ ID NO: 9 - protein, 31 aa, Clitoria ternatea
GVPCAESCVWIPCTVTALLGCSCKDKVCYLD

SEQ ID NO: 10 - protein, 31 aa, Clitoria ternatea
GIPCAESCVWIPCTVTALLGCSCKDKVCYLD

SEQ ID NO: 11 - protein, 31 aa, Clitoria ternatea
GIPCAESCVWIPCTVTALLGCSCKDKVCYLN

SEQ ID NO: 12 - protein, 31 aa, Clitoria ternatea
GIPCGESCVFIPCTVTALLGCSCKDKVCYKN

SEQ ID NO: 13 - protein, 7 aa, Clitoria ternatea
PTCGETC

SEQ ID NO: 14 - protein, 30 aa, Clitoria ternatea
GIPCGESCVFIPCISTVIGCSCKNKVCYRN

SEQ ID NO: 15 - protein, 30 aa, Clitoria ternatea
GLPCGESCVFIPCITTVVGCSCKNKVCYNN

SEQ ID NO: 16 - protein, 30 aa, Clitoria ternatea
GLPCGESCVFIPCITTVVGCSCKNKVCYND

SEQ ID NO: 17 - protein, 29 aa, Clitoria ternatea
HEPCGESCVFIPCITTVVGCSCKNKVCYN

SEQ ID NO: 18 - protein, 29 aa, Clitoria ternatea
HEPCGESCVFIPCITTVVGCSCKNKVCYD

SEQ ID NO: 19 - protein, 30 aa, Clitoria ternatea
GIPCGESCVFIPCISSVVGCSCKSKVCYLD

SEQ ID NO: 20 - protein, 30 aa, Clitoria ternatea
GIPCGESCVFIPCITAAIGCSCKSKVCYRN

SEQ ID NO: 21 - protein, 31 aa, Clitoria ternatea
GVIPCGESCVFIPCITAAVGCSCKNKVCYRD

SEQ ID NO: 22 - protein, 31 aa, Clitoria ternatea
GTVPCGESCVFIPCITGIAGCSCKNKVCYIN

SEQ ID NO: 23 - protein, 31 aa, Clitoria ternatea
GTVPCGESCVFIPCITGIAGCSCKNKVCYID

SEQ ID NO: 24 - protein, 30 aa, Clitoria ternatea
GIPCGESCVFIPCITGIAGCSCKSKVCYRN

SEQ ID NO: 25 - protein, 29 aa, Clitoria ternatea
GLPTCGETCTLGTCYVPDCSCSWPICMKN

SEQ ID NO: 26 - protein, 29 aa, Clitoria ternatea
GSAFCGETCVLGTCYTPDCSCTALVCLKN

SEQ ID NO: 27 - DNA, 511 bp, Clitoria ternatea
acagcaaaagagtaattccttattttcatcaactatggcttacgttagacttacttctcttgccgttctcttcttccttgctgcttccgttatgaagacagaaggaggacttcctaccggagaaacttgtaccctggggacatgttatgtgccagattgttcatgttcatggccaatttgcatgaaaaatcatatcattgcagctaatgcaaaaacagtgaatgaacatcgtctcttatgtacatctcatgaagactgttttaagaaaggcactggaaactattgtgcttcttttcccgattctaacatccattttggttggtgtttccatgctgaatctgaaggatatttgttgaaagactttatgaatatgtcaaaggatgacttaaagatgcctttggaaagtaccaactaaaagtgatcatgtatgatacatctataaatttaaataaatgctatgaagcatatctactattttaaataaaaaaaaaaaaaaaaaaaaaaaaaaaaa

SEQ ID NO: 28 - protein, 127 aa, Clitoria ternatea
MAYVRLTSLAVLFFLAASVMKTEGGLPTCGETCTLGTCYVPDCSCSWPICMKNHIIAANAKTVNEHRLLCTSHEDCFKKGTGNYCASFPDSNIHFGWCFHAESEGYLLKDFMNMSKDDLKMPLESTN

SEQ ID NO: 29 - protein, 124 aa, Oldenlandia affinis
MAKFTVCLLLCLLLAAFVGAFGSELSDSHKTTLVNEIAEKMLQRKILDGVEATLVTDVAEKMFLRKMKAEAKTSETADQVFLKQLQLKGLPVCGETCVGGTCNTPGCTCSWPVCTRNGLPSLAA

SEQ ID NO: 30 - protein, 158 aa, Oldenlandia affinis
MAKFTKSLVLCLLLAAFVGAFGAELSEADKANVVNEIAANIQREILKGVKSSETTLTMFLKEMQLKGLPTCGETCFGGTCNTPGCSCSSWPICTRNGLPKRAGVKSSETTLTMFLKEMQLKGLPTCGETCFGGTCNTPGCTCDPWPICTRDGLPSAAA

SEQ ID NO: 31 - protein, 208 aa, Oldenlandia affinis
MAKFTNCLVLSLLLAAFVGAFGAEFSEADKATLVNDIAENIQKEILGEVKTSETVLTMFLKEMQLKGLPVCGETCFGGTCNTPGCSCTWPICTRDSLPMRAGGKTSETTLHMFLKEMQLKGLPVCETCFGGTCNTPGCSCTWPICTRDSLPMSAGGKTETTLHMFLKEMQLKGLPVCGETCFGGTCNTPGCSCTWPICTRDSLPLVAA

SEQ ID NO: 32 - protein, 119 aa, Glycine max
MAVFLLATSTIMFPTKIEAADCNGACSPFEVPPCRSRDCRCVPIGLFVGFCIHPTGLSSVAKMIDEHPNLCQSDDECMKKGSGNFCARYPNNYIDYGWCFDSDSEALKGFLAMPRATTK

SEQ ID NO: 33 - protein, 131 aa, Pisum sativum
MASVKLASLIVLFATLGMFLTKNVGAASCNGVCSPFEMPPCGTSACRCIPVGLFIGYCRNPSGVFLKANDEHPNLCESDADCRKKGSGNFCGHYPNPDIEYGWCFASKSEAEDFFSDKITPKDLLKSVSTA

SEQ ID NO: 34 - protein, 94 aa, Clitoria ternatea
VQGECYTPGCSCDWPICKKNHIIATNAKTVNQHRLLCESHEDCFKKGTGNYCAFFPDSDVHFGWCFYAESDGYLSKDFFKMSKDNLKMPMTIIN

SEQ ID NO: 35 - protein, 82 aa, Clitoria ternatea
ITAAIGCSCKSKVCYRNHVIAAEAKTMDDHHLLCQSHEDCITKGTGNFCAPFPDQDIKYGWCFRAESEGFLLKDHLKMSITN

SEQ ID NO: 36 - protein, 82 aa, Clitoria ternatea
ITGAIGCSCKSKVCYRNHVIAAEAKTMDDHHLLCQSHEDCITKGTGNFCAPFPDQDIKYGWCFRAESEGFMLKDHLKMSITN

SEQ ID NO: 37 - protein, 119 aa, Glycine max
MAVFLLATSTIMFPTKIEAADCNGACSPFEVPPCRSRDCRCVPIGLFVGFCIHPTGLSSVAKMVDEHPNLCQSDDECMKKGSGNFCARYPNNYIDYGWCFDSDSEALKGFLAMPRATTK

SEQ ID NO: 38 - protein, 119 aa, Glycine max; identical to SEQ ID NO: 37

SEQ ID NO: 39 - protein, 100 aa, Glycine max
MAVFLLATSTIMFPTKIEAADCNGACSPFEMPPCRSRDCRCVPIGLVAGFCIHPTGLSSVAKMIDEHPNLCQSDDECMKKGSGNFCARYPNNYIDYGWCF

SEQ ID NO: 40 - protein, 100 aa, Glycine max; identical to SEQ ID NO: 39

SEQ ID NO: 41 - protein, 118 aa, Glycine max
MAVFLLATSTIMFPTKIEAADCNGACSPFEVPPCRSRDCRCVPIGLFVGFCIHPTGLSSVAKMIDEHPNLCQSDDECMKKGSGNFCARYPNNYIDYGWCFDSDSEALKGFLAMPRATT

SEQ ID NO: 42 - protein, 119 aa, Glycine max; identical to SEQ ID NO: 32

SEQ ID NO: 43 - protein, 119 aa, Glycine soja
MAVFLLATSTIMFPTKIEAADCNGACSPFEVPPCRSSDCRCVPIGLFVGFCIHPTGLSSVAKMVDEHPNLCQSDDECMKKGSGNFCARYPNNYIDYGWCFDSDSEALKGFLAMPRATTK

SEQ ID NO: 44 - protein, 119 aa, Glycine soja; identical to SEQ ID NO: 43

SEQ ID NO: 45 - protein, 81 aa, Lupinus angustifolius
IPPSRSSDCRCVPITLIVGFCIHPTGLSSVAKMIDEHPNLCQSDDECMKKGSGNFCARYPNNYIDYGWCFGSDSEALKGFL

SEQ ID NO: 46 - protein, 81 aa, Lupinus angustifolius; identical to SEQ ID NO: 45

SEQ ID NO: 47 - protein, 90 aa, Phaseolus angularis
AADCNGACSPFQMPPCGSTDCLCIPAGLLFVGYCTYPSGLSSVAKMIDEHPNLCQSDDECMKKGSGNFCARYPNNYMDYGWCFDSDSEAL

SEQ ID NO: 48 - protein, 90 aa, Vigna angularis; identical to SEQ ID NO: 47

SEQ ID NO: 49 - protein, 89 aa, Vigna radiata
AADCNGACSPFEMPPCRSTDCRCIPIALFGGFCINPTGLSSVAKMIDEHPNLCQSDDECLKKGSGNFCARYPNHYMDYGWCFDSDSEAL

SEQ ID NO: 50 - protein, 89 aa, Vigna radiata; identical to SEQ ID NO: 49

SEQ ID NO: 51 - protein, 58 aa, Vigna subterranea
GSRDCCCIPIGLFVGFCIYPTGLSSVSKMIDEHPNLCQSHDECMKKGSGNFCARYPNN

SEQ ID NO: 52 - protein, 58 aa, Vigna subterranea; identical to SEQ ID NO: 51

SEQ ID NO: 53 - protein, 58 aa, Vigna unguiculata
GSRDCRCIPVGLVVGFCIYPTGLSSVAKMIEEHPNLCQSDDECVKKGSGNFCARYPNN

SEQ ID NO: 54 - protein, 58 aa, Vigna unguiculata; identical to SEQ ID NO: 53

SEQ ID NO: 55 - protein, 99 aa, Bituminaria bituminosa
MVCVRVPPLALFLLATSLMFSTKKIEACSGACFPFQMPPCGSTDCRCVPWGLFVGQCIDPIGGVASFAKMIDDHPNLCQSNEDCIKKRSGDFCARFPNN

SEQ ID NO: 56 - protein, 99 aa, Bituminaria bituminosa; identical to SEQ ID NO: 55

SEQ ID NO: 57 - protein, 59 aa, Bituminaria bituminosa
GSTDCRCVPWGLFAGQCIDPIGGVASFAKMIDDHPNLCQSNEDCIKKRSGDFCARYPNN

SEQ ID NO: 58 - protein, 59 aa, Bituminaria bituminosa; identical to SEQ ID NO: 57

SEQ ID NO: 59 - protein, 91 aa, Alysicarpus ovalifolius
MEAVFWYSLLFTTKNIEAADCSGACSPFERPLCGSTDCRCIPIVLLAGFCIYPTGLASVANLIDNHPNLCKTHDECIKKGSGNFCARFPNP

SEQ ID NO: 60 - protein, 109 aa, Phaseolus vulgaris
MANVRVAPLALFLLATSIMFPMKKTEAVVCSGVCSPFERPPCGSTRDCRCIPYGLFIGACTYPSGLSSVAKTIDEHPNICQTHEECTKKGSGNFCARYPNDDIDYGWCF

SEQ ID NO: 61 - protein, 102 aa, Phaseolus vulgaris
MANVRVAPLALFLLATSIMFPMKKTEAVVCSGVCSPFERPPCGSTRDCRCIPYGLFIGACTYPSGLSSVAKTIDEHPNICQTHEECTKKGSGNFCARYPNDD

SEQ ID NO: 62 - protein, 98 aa, Canavalia brasiliensis
MAYAKFAPLAVFLFATFLMLSMKKIEACSGGCSPFEMPPCGSSDCRCIPWGLVAGYCINPTSLAAAAKMIEAHPHLCQSNDECLKKGSGNFCARFPNP

SEQ ID NO: 63 - protein, 98 aa, Canavalia brasiliensis; identical to SEQ ID NO: 62

SEQ ID NO: 64 - protein, 58 aa, Canavalia brasiliensis
GSGECRCVPAGLVVGFCTNPTSLASAAKMIEAHLHLCQSNDECLKKGSGNFCARFPNP

SEQ ID NO: 65 - protein, 58 aa, Canavalia brasiliensis; identical to SEQ ID NO: 64

SEQ ID NO: 66 - protein, 60 aa, Mundulea sericea
GDAQNCRCIPILLFGGLCIHPTGLDTKMIDQHPNLCQSNEECTKKGSGNFCARYPNPDIE

SEQ ID NO: 67 - protein, 60 aa, Mundulea sericea; identical to SEQ ID NO: 66

SEQ ID NO: 68 - protein, 101 aa, Mundulea sericea
MASLRVAPLAVFFLATSVMLPMTRGSCNGRDWCSPFEMPPCGDAQNCRCIPVVLVGGYCRHPSGLDTKKIDQHPNLCQSNDECMKKGSGNFCARYPNPDIE

SEQ ID NO: 69 - protein, 101 aa, Mundulea sericea; identical to SEQ ID NO: 68

SEQ ID NO: 70 - protein, 101 aa, Mundulea sericea
MASLRVAPLAVFFLATSVMFPMIRGDCNGRVVCSPFEMPPCGDAQKCRCIPYLLAGGLYTPPTPSVTRMIDQHPNLCQSNDECMKKGSGNFCARYPNPDIE

SEQ ID NO: 71 - protein, 101 aa, Philenoptera violacea
MAYVRLVPLAVFLLATSVMLPMKIKASCNGRDVCSPFEMPPCDDATNCRCIPWGLVVGQCVHPSGLPSVAKMIDKHLNLCQSNDECMKKGSGNFCARYPNP

SEQ ID NO: 72 - protein, 101 aa, Philenoptera violacea; identical to SEQ ID NO: 71

SEQ ID NO: 73 - protein, 142 aa, Medicago truncatula
MAYLRLAHLVVFLHATFSLIFPMMKAAEDCSGICSPFEMPPCPSSSCRCIPVILIGGNYVDPSSPTITKMVEKHANLCQSHADCTKKGSGSFCARYPNPDIEYGWCFSSNSKAQEVFFKISSNPRFMEDLKIKPGTCGSFFY

SEQ ID NO: 74 - protein, 142 aa, Medicago truncatula; identical to SEQ ID NO: 73

SEQ ID NO: 75 - protein, 98 aa, Melilotus alba
MAYVKLAPLVVFLLAAFSIFPMMKGEEECSGICSSFEMPPCRSSSCRCIPVVLLGGNCVDPSSPTIMKMVEEHSNLCQSHFECMKKGSGSFCARYPNP

SEQ ID NO: 76 - protein, 140 aa, Medicago truncatula
MAYIRFAHLVVFLLAAFSLVPTKKVGATDCSGACSPFEMPPCRSSDCRCIPIGLVAGYCTYPSSPTVMKMVEEHPNLCQSHADCTKKESGSFCARYPNPDIEHGWCFSSNFEAYDVFFNVSSNRGLIKDSLPMFTLTLDS

SEQ ID NO: 77 - protein, 140 aa, Medicago truncatula; identical to SEQ ID NO: 76

SEQ ID NO: 78 - protein, 99 aa, Trigonella foenum-graecum
MAYVRLTHLVVFLLSTFSLFPMKKVGATDCSGICSPFEMPPCRSSDCRCIPIVLVGGYCINPISPAATKMVKEHPNLCHSHTDCTKKGSGSFCARYPNP

SEQ ID NO: 79 - protein, 99 aa, Trigonella foenum-graecum; identical to SEQ ID NO: 78

SEQ ID NO: 80 - protein, 60 aa, Onobrychis viciifolia
RSSDCRCIPIALVMGYCRYPSSVSNDAVTRMAKEHPNLCQSHADCKNKRSGSFCARYPNP

SEQ ID NO: 81 - protein, 98 aa, Onobrychis viciifolia
MPNYFKLTPLVLFLIATFLMFPMKKVEACDGVCSPFEMPPCGSTDCRCVPWGLFVGQCINPTSATVEKMVKEHPNLCQSHVDCMEKGSGSFCGRYPNA

SEQ ID NO: 82 - protein, 100 aa, Astragalus monspessulanus
MGSVKLAPLALFLFATFLMFPAKNVEATDCSGVCSPFEMPPCGSTDCRCIPWGLFVGECKYPTGSERVTKMVEKHPNLCQSHDDCVHKESGSFCARYPNA

SEQ ID NO: 83 - protein, 58 aa, Caragana arborescens
GSSSCRCIPWGLFWGTCRYPSGSGRVIKKVGEHPNLCESHADCMKKESGSFCGRYPNP

SEQ ID NO: 84 - protein, 130 aa, Pisum sativum
MASVKLASLMVLFATLGMFLTKNVGAASCNGVCSPFEMPPCGSSACRCIPVGLVVGYCRHPSGVFLRTNDEHPNLCESDADCRKKGSGNFCGHYPNPDIEYGWCFASKSEAEDFFSKITQKDLLKSVSTA

SEQ ID NO: 85 - protein, 130 aa, Pisum sativum; identical to SEQ ID NO: 84

SEQ ID NO: 86 - protein, 130 aa, Pisum sativum
MASVKLASLIVLFATLGMFLTKNVGAASCNGVCSPFEMPPCGSSACRCIPVGLVVGYCRHPSGVFLRTNDEHPNLCESDADCRKKGSGNFCGHYPNPDIEYGWCFASKSEAEDFFSKITPKDLLKSVSTA

SEQ ID NO: 87 - protein, 130 aa, Pisum sativum; identical to SEQ ID NO: 86

SEQ ID NO: 88 - protein, 130 aa, Pisum sativum
MASVKLASLIVLFATLGMFLTKNVGAASCNGVCSPFEMPPCGTSACRCIPVGLVVGYCRNPSGVFLRTNDEHPNLCESDADCRKKGSGNFCGHYPNPDIEYGWCFASKSEAEDFFSKITPKDLLKSVSTA

SEQ ID NO: 89 - protein, 130 aa, Pisum sativum; identical to SEQ ID NO: 88

SEQ ID NO: 90 - protein, 130 aa, Pisum sativum
MASVKLASLIVLFATLGMFLTKNVGAASCNGVCSPFEMPPCGTSACRCIPVGLFIGYCRNPSGVFLKANDEHPNLCESDADCRKKGSGNFCGHYPNPDIEYGWCFASKSEAEDFFSKITPKDLLKSVSTA

SEQ ID NO: 91 - protein, 54 aa, Pisum sativum
DEHPNLCESDADCRKKGSGNFCGHYPNPDIEYGWCFASKSEAEDFFSKITPKDD

SEQ ID NO: 92 - protein, 130 aa, Pisum sativum; identical to SEQ ID NO: 90

SEQ ID NO: 93 - protein, 130 aa, Pisum sativum
MASVKLASLIVLFATLGMFLTKNVGAASCNGVCSPFEMPPCGTSACRCIPVGLVIGYCRNPSGVFLRTNDEHPNLCESDADCRKKGSGKFCGHYPNPGIEYGWCFASKSEAEDFFSKITQKDLLKSVSTA

SEQ ID NO: 94 - protein, 130 aa, Pisum sativum; identical to SEQ ID NO: 93

SEQ ID NO: 95 - protein, 130 aa, Pisum sativum
MASVKLASLIVLFATLGMFLTKNVGAASCNGVCSPFEMPPCGSSACRCIPVGLLIGYCRNPSGVFLKGNDEHPNLCESDADCKKKGSGNFCGHYPNPDIEYGWCFASKSEAEDVFSKITPKDLLKSVSTA

SEQ ID NO: 96 - protein, 130 aa, Pisum sativum; identical to SEQ ID NO: 95

SEQ ID NO: 97 - protein, 130 aa, Pisum sativum; identical to SEQ ID NO: 95

SEQ ID NO: 98 - protein, 130 aa, Pisum sativum
MASVKLASLIVLFATLGMFLTKNVGAISCNGVCSPFDIPPCGSPLCRCIPAGLVIGNCRNPYGVFLRTNDEHPNLCESDADCRKKGSGTFCGHYPNPDIEYGWCFASKSEAEDVFSKITPKDLLKSVSTA

SEQ ID NO: 99 - protein, 130 aa, Pisum sativum; identical to SEQ ID NO: 98

SEQ ID NO: 100 - protein, 59 aa, Lathyrus latifolius
RSKDCRCIPVGLVVGYCRHPSGIFLRTTDKHPNLCESDADCRKKESGNFCGHYPNPDIE

SEQ ID NO: 101 - protein, 96 aa, Vicia hirsuta
MAYVQLAYLVVLFATFGMFLTQNVEAAECNGVCSPFEMPPCGSSDCRCIPVGLVVGYCRYPSGLRNTIEEHPNLCKSNLDCIEKESGKFCGHYPNP

SEQ ID NO: 102 - protein, 154 aa, Medicago truncatula
MTYVKLITLALFLVTTLLMFQTKNVEAEFCSSVGSFCSPFNTNPCGYLGNCRCVPYYLYGGTCENPFGFEHNMKMIEEHPNLCQTHAECIKKGSENFCARYANADVEYGWCFASVAEAERYFKIGSNTAVKSLFKIASKSKEQDYLKMALEIAT

SEQ ID NO: 103 - protein, 154 aa, Medicago truncatula; identical to SEQ ID NO: 102

SEQ ID NO: 104 - protein, 70 aa, Clitoria ternatea
MAYVRLTSLAVLFFLAASVMKTEGGLPTCGETCTLGTCYVPDCSCSWPICMKNHIIAANAKTVNEHRLLC

SEQ ID NO: 105 - protein, 70 aa, Clitoria ternatea
MAYFTVCLLLCLLLAAFVGAFGSELSDSHKTTLVNEIAEKMLQRKILDGVEATLVTDVAEKMFLRKMKAE

SEQ ID NO: 106 - protein, 70 aa, Clitoria ternatea
MASVKLASLIVLFATLGMFLTKNVGAASCNGVCSPFEMPPCGTSACRCIPVGLFIGYCRNPSGVFLKAND

SEQ ID NO: 107 - protein, 69 aa, Clitoria ternatea
MAYIFAHLVVFLLAAFSLVPTKKVGATDCSGACSPFEMPPCRSSDCRCIPIGLVAGYCTYPSSPTVMKM

SEQ ID NO: 108 - protein, 70 aa, Clitoria ternatea
MGYVRVAPLALFLLATSIMFPNKKTEAVVCSGVCSPFERPPCGSTRDRRCIPYGLFIGACTNPSGLSSVA

SEQ ID NO: 109 - protein, 70 aa, Clitoria ternatea
MAVFLLATSTIMFPTKIEAADCNGACSPFEVPPCRSRDCRCVPIGLFVGFCIHPTGLSSVAKMIDEHPNL

SEQ ID NO: 110 - protein, 7 aa, Artificial sequence
  Synthetic
YRNGVIP

SEQ ID NO: 111 - protein, 7 aa, Artificial sequence
  Synthetic
YLNGVIP

SEQ ID NO: 112 - protein, 6 aa, Artificial sequence
  Synthetic
YLDGVP

SEQ ID NO: 113 - protein, 6 aa, Artificial sequence
  Synthetic
YLNGIP

SEQ ID NO: 114 - protein, 6 aa, Artificial sequence
  Synthetic
YLDGIP

SEQ ID NO: 115 - protein, 6 aa, Artificial sequence
  Synthetic
YLNGLP

SEQ ID NO: 116 - protein, 6 aa, Artificial sequence
  Synthetic
YNNGLP

SEQ ID NO: 117 - protein, 6 aa, Artificial sequence
  Synthetic
YNDGLP

SEQ ID NO: 118 - protein, 7 aa, Artificial sequence
  Synthetic
YINGTVP

SEQ ID NO: 119 - protein, 7 aa, Artificial sequence
  Synthetic
YIDGTVP

SEQ ID NO: 120 - protein, 5 aa, Artificial sequence
  Synthetic
YNHEP

SEQ ID NO: 121 - protein, 5 aa, Artificial sequence
  Synthetic
YDHEP

SEQ ID NO: 122 - protein, 7 aa, Artificial sequence
  Synthetic
LKNGSAF

SEQ ID NO: 123 - protein, 6 aa, Artificial sequence
  Synthetic
MKNGLP

SEQ ID NO: 124 - protein, 6 aa, Artificial sequence
  Synthetic
YRNGIP

SEQ ID NO: 125 - protein, 6 aa, Artificial sequence
  Synthetic
YKNGIP

SEQ ID NO: 126 - protein, 7 aa, Artificial sequence
  Synthetic
YRDGVIP

SEQ ID NO: 127 - DNA, 72 bp, Clitoria ternatea
atggcttacgttagacttacttctcttgccgttctcttcttccttgctgcttccgttatgaagacagaagga

SEQ ID NO: 128 - protein, 24 aa, Clitoria ternatea
MAYVRLTSLAVLFFLAASVMKTEG

SEQ ID NO: 129 - protein, 12 aa, Clitoria ternatea
KNGLPTCGETCL

SEQ ID NO: 130 - protein, 12 aa, Clitoria ternatea
VPDCSCSWPICM

SEQ ID NO: 131 - protein, 16 aa, Clitoria ternatea
KNGLPTCGETCLGTCY

SEQ ID NO: 132 - protein, 6 aa, Clitoria ternatea
DKVCYL

SEQ ID NO: 133 - protein, 6 aa, Clitoria ternatea
GVPCAE

SEQ ID NO: 134 - protein, 7 aa, Clitoria ternatea
DKVCYLN

SEQ ID NO: 135 - protein, 7 aa, Clitoria ternatea
NGVPCAE

SEQ ID NO: 136 - protein, 13 aa, Clitoria ternatea
DKVCYLDGVPCAE

SEQ ID NO: 137 - protein, 6 aa, Artificial sequence
  Synthetic
YNNGLP

SEQ ID NO: 138 - protein, 6 aa, Artificial sequence
  Synthetic
YFNDIF

SEQ ID NO: 139 - protein, 5 aa, Artificial sequence
  Synthetic
YNHEP

SEQ ID NO: 140 - protein, 5 aa, Artificial sequence
  Synthetic
YDHEP

SEQ ID NO: 141 - protein, 6 aa, Artificial sequence
  Synthetic
YHDKIP

SEQ ID NO: 142 - protein, 6 aa, Artificial sequence
  Synthetic
YNDGIP

SEQ ID NO: 143 - protein, 26 aa, Clitoria ternatea
TLGTCYVPDCSCSWPICMKNGLPTCE

SEQ ID NO: 144 - protein, 20 aa, Artificial sequence
  Synthetic
CCIACNTGYGGNGARACNTG

SEQ ID NO: 145 - DNA, 8 bp, Artificial
  Synthetic
gcccgggt

SEQ ID NO: 146 - DNA, 24 bp, Artificial
  Synthetic
ggaaacaccaaccaaaatggatgt

SEQ ID NO: 147 - DNA, 24 bp, Artificial
  Synthetic
tcactgtttttgcattagctgcaa

SEQ ID NO: 148 - DNA, 26 bp, Artificial
  Synthetic
tccttattttcatcaactatggctta

SEQ ID NO: 149 - DNA, 24 bp, Artificial
  Synthetic
tcatacatgatcacttttagttgg

SEQ ID NO: 150 - DNA, 81 bp, Phaseolus vugaris
atgggttatgttagggttgctcctttggctctcttcttgcttgccacttccatgatgttttcgatgaagaagatagaagct

SEQ ID NO: 151 - protein, 27 aa, Phaseolus vugaris
MGYVRVAPLALFLLATSMMFSMKKIEA

SEQ ID NO: 152 - DNA, 81 bp, Phaseolus vugaris
atgggttatgttagggttgctcctttggctctcttcttgcttgccacttccataatgtttccgatgaagaagacagaggca

SEQ ID NO: 153 - protein, 27 aa, Phaseolus vugaris
MGYVRVAPLALFLLATSIMFPMKKTEA

SEQ ID NO: 154 - DNA, 78 bp, Pisum sativum
atggcttccgttaaactcgcttctttgatcgtcttgtttgccacattaggtatgttcctgacaaaaaacgtaggggca

SEQ ID NO: 155 - protein, 26 aa, Pisum sativum
MASVKLASLIVLFATLGMFLTKNVGA

SEQ ID NO: 156 - DNA, 81 bp, Medicago truncatula
atgacttatgttaagctcattactttggctctattcctggttaccacactcttaatgtttcagacaaagaatgttgaagca

SEQ ID NO: 157 - protein, 27 aa, Medicago truncatula
MTYVKLITLALFLVTTLLMFQTKNVEA

SEQ ID NO: 158 - DNA, 81 bp, Medicago truncatula
atggcttatgttaagcttgcttcttttgctgtcttcttgcttgctgcattcgtaatgtttccgatgaaaaaagtagaagga

SEQ ID NO: 159 - protein, 27 aa, Medicago truncatula
MAYVKLASFAVFLLAAFVMFPMKKVEG

SEQ ID NO: 160 - DNA, 57 bp, Glycine max
atggctgtcttcttgcttgccacttccaccataatgttcccaacgaagatagaagca

SEQ ID NO: 161 - protein, 19 aa, Glycine max
MAVFLLATSTIMFPTKIEA

SEQ ID NO: 162 - protein, 6 aa, Tachypleus tridentatus
QLQGFN

SEQ ID NO: 163 - protein, 6 aa, Tachypleus tridentatus
QLQGFN

SEQ ID NO: 164 - protein, 6 aa, Tachypleus tridentatus
LFRGAR

SEQ ID NO: 165 - protein, 6 aa, Tachypleus tridentatus
LFRGAR

SEQ ID NO: 166 - protein, 6 aa, Takifugu rubripes
LPLGGS

SEQ ID NO: 167 - protein, 6 aa, Takifugu rubripes
SQLTQS

SEQ ID NO: 168 - protein, 6 aa, Takifugu rubripes
IPHQQS

SEQ ID NO: 169 - protein, 6 aa, Takifugu rubripes
SRLMES

SEQ ID NO: 170 - protein, 6 aa, Aotus sp. Aot1
VATRGS

SEQ ID NO: 171 - protein, 6 aa, Mus musculus
VATRDS

SEQ ID NO: 172 - protein, 6 aa, Canis lupus
VATRNS

SEQ ID NO: 173 - protein, 6 aa, Tetrao urogallus
VRLLES

SEQ ID NO: 174 - protein, 6 aa, Tragopan temminckii
VRLLES

SEQ ID NO: 175 - protein, 6 aa, Tragopan satyra
VRLLES

SEQ ID NO: 176 - protein, 6 aa, Syrmaticus reevesii
VRLLES

SEQ ID NO: 177 - protein, 6 aa, Rollulus roulroul
VRLLES

SEQ ID NO: 178 - protein, 6 aa, Perdix perdix
VRLLES

SEQ ID NO: 179 - protein, 6 aa, Polyplectron malacense
VRLLES

SEQ ID NO: 180 - protein, 6 aa, Pavo muticus
VRLLES

SEQ ID NO: 181 - protein, 6 aa, Polyplectron inopinatum
VRLLES

SEQ ID NO: 182 - protein, 6 aa, Polyplectron napolenois
VRLLES

SEQ ID NO: 183 - protein, 6 aa, Phasianus colchincus
VRLLES

SEQ ID NO: 184 - protein, 6 aa, Pavo cristatus
VRLLES

SEQ ID NO: 185 - protein, 6 aa, Melegaris gallopavo
VRLLES

SEQ ID NO: 186 - protein, 6 aa, Tetrao tetrix
VRLLES

SEQ ID NO: 187 - protein, 6 aa, Lophura nycthemera
VRLLES

SEQ ID NO: 188 - protein, 6 aa, Lagopus lagopus scotica
VRLLES

SEQ ID NO: 189 - protein, 6 aa, Lophophorus impejanus
VRLLES

SEQ ID NO: 190 - protein, 6 aa, Lophura edwardsi
VRLLES

SEQ ID NO: 191 - protein, 6 aa, Lophura diardi
VRLLES

SEQ ID NO: 192 - protein, 6 aa, Gallus sonneratii
VRLLES

SEQ ID NO: 193 - protein, 6 aa, Francolinus pondicerianus
VRLLES

SEQ ID NO: 194 - protein, 6 aa, Francolinus levaillantii
VRLLES

SEQ ID NO: 195 - protein, 6 aa, Catreus wallichii
VRLLES

SEQ ID NO: 196 - protein, 6 aa, Crossoptilon mantchuricum
VRLLES

SEQ ID NO: 197 - protein, 6 aa, Coturnix coturnix japonica
VRLLES

SEQ ID NO: 198 - protein, 6 aa, Coturnix coturnix
VRLLES

SEQ ID NO: 199 - protein, 6 aa, Crossoptilon crossoptilon
VRLLES

SEQ ID NO: 200 - protein, 6 aa, Alectoris chukar
VRLLES

SEQ ID NO: 201 - protein, 6 aa, Afropavo congensis
VRLLES

SEQ ID NO: 202 - protein, 6 aa, Argusianus argus
VRLLES

SEQ ID NO: 203 - protein, 6 aa, Alectoris rufa
VRLLES

SEQ ID NO: 204 - protein, 6 aa, Peromyscus maniculatus
VATRDS

SEQ ID NO: 205 - protein, 6 aa, Peromyscus polionotus subgriseus
VATRDS

SEQ ID NO: 206 - protein, 6 aa, Peromyscus polionotus leucocephalus
VATRDS

SEQ ID NO: 207 - protein, 6 aa, Coturnix coturnix japonica
VPNFKT

SEQ ID NO: 208 - protein, 6 aa, Coturnix coturnix japonica
VPNFKT

SEQ ID NO: 209 - protein, 6 aa, Capra hircus
VATRDS

SEQ ID NO: 210 - protein, 6 aa, Bos taurus
VRLHES

SEQ ID NO: 211 - protein, 6 aa, Homo sapiens
VRLHES

SEQ ID NO: 212 - protein, 6 aa, Mus musculus
VRLHES

SEQ ID NO: 213 - protein, 6 aa, Sus scrofa
VRLHES

SEQ ID NO: 214 - protein, 6 aa, Bos taurus
VATRDS

SEQ ID NO: 215 - protein, 6 aa, Callithrix geoffroyi
VSTRGS

SEQ ID NO: 216 - protein, 6 aa, Callimico goeldii
VSTRGS

SEQ ID NO: 217 - protein, 6 aa, Callithrix jacchus
VSTRGS

SEQ ID NO: 218 - protein, 6 aa, Canis familiaris
VATRNS

SEQ ID NO: 219 - protein, 6 aa, Cebuella pygmaea
VSTRGS

SEQ ID NO: 220 - protein, 6 aa, Chlorocebus aethiops
VATRDS

SEQ ID NO: 221 - protein, 6 aa, Cercopithecus mitis
VATRDS

SEQ ID NO: 222 - protein, 6 aa, Colobus polykomos
VATRDS

SEQ ID NO: 223 - protein, 6 aa, Erythrocebus patas
VATRDS

SEQ ID NO: 224 - protein, 6 aa, Felis catus
VATRDS

SEQ ID NO: 225 - protein, 6 aa, Gorilla gorilla gorilla
VATRNS

SEQ ID NO: 226 - protein, 6 aa, Equus caballus
VATRDS

SEQ ID NO: 227 - protein, 6 aa, Homo sapiens
VATRNS

SEQ ID NO: 228 - protein, 6 aa, Leontopithecus chrysomelas
VSTRGS

SEQ ID NO: 229 - protein, 6 aa, Leontopithecus rosalia
VSTRGS

SEQ ID NO: 230 - protein, 6 aa, Macaca arctoides
VATRDS

SEQ ID NO: 231 - protein, 6 aa, Macaca assamensis
VATRDS

SEQ ID NO: 232 - protein, 6 aa, Macaca cyclopis
VATRDS

SEQ ID NO: 233 - protein, 6 aa, Macaca fascicularis
VATRDS

SEQ ID NO: 234 - protein, 6 aa, Macaca fuscata fuscata
VATRDS

SEQ ID NO: 235 - protein, 6 aa, Macaca hecki
VATRDS

SEQ ID NO: 236 - protein, 6 aa, Macaca maura
VATRDS

SEQ ID NO: 237 - protein, 6 aa, Macaca mulatta
VATRDS

SEQ ID NO: 238 - protein, 6 aa, Macaca nemestrina
VATRDS

SEQ ID NO: 239 - protein, 6 aa, Macaca nigra
VATRDS

SEQ ID NO: 240 - protein, 6 aa, Macaca nigrescens
VATRDS

SEQ ID NO: 241 - protein, 6 aa, Macaca radiata
VATRDS

SEQ ID NO: 242 - protein, 6 aa, Macaca sinica
VATRDS

SEQ ID NO: 243 - protein, 6 aa, Macaca silenus
VTTRDS

SEQ ID NO: 244 - protein, 6 aa, Macaca sylvanus
VATRDS

SEQ ID NO: 245 - protein, 6 aa, Mus musculus
VATRDS

SEQ ID NO: 246 - protein, 6 aa, Pan paniscus
VATRNS

SEQ ID NO: 247 - protein, 6 aa, Pan troglodytes
VATRNS

SEQ ID NO: 248 - protein, 6 aa, Papio anubis
VATRDS

SEQ ID NO: 249 - protein, 6 aa, Sus scrofa
VANRDS

SEQ ID NO: 250 - protein, 6 aa, Pongo pygmaeus
VATRNS

SEQ ID NO: 251 - protein, 6 aa, Rattus norvegicus
VATRDS

SEQ ID NO: 252 - protein, 6 aa, Semnopithecus entellus
VATRYS

SEQ ID NO: 253 - protein, 6 aa, Trachypithecus auratus
VATRDS

SEQ ID NO: 254 - protein, 6 aa, Trachypithecus cristatus
VATRDS

SEQ ID NO: 255 - protein, 6 aa, Trachypithecus francoisi
VATRDS

SEQ ID NO: 256 - protein, 6 aa, Trachypithecus obscurus
VATRDS

SEQ ID NO: 257 - protein, 6 aa, Vulpes vulpes
VATRNS

SEQ ID NO: 258 - protein, 6 aa, Oryctolagus cuniculus
VATRDS

SEQ ID NO: 259 - protein, 6 aa, Coturnix coturnix japonica
VPNFKT

SEQ ID NO: 260 - protein, 6 aa, Gallus gallus
VPNFKT

SEQ ID NO: 261 - protein, 6 aa, Gallus gallus
VPNFKT

SEQ ID NO: 262 - protein, 6 aa, Gallus gallus
VPNFKT

SEQ ID NO: 263 - protein, 6 aa, Mus musculus
VRLHES

SEQ ID NO: 264 - protein, 6 aa, Capra hircus
VATRDS

SEQ ID NO: 265 - protein, 6 aa, Tetraodon nigroviridis
IPHQQS

SEQ ID NO: 266 - protein, 6 aa, Tetraodon nigroviridis
SRLKDS

SEQ ID NO: 267 - protein, 6 aa, Carassius auratus
VPLWGS

SEQ ID NO: 268 - protein, 6 aa, Carassius auratus
VPLWGS

SEQ ID NO: 269 - protein, 6 aa, Carassius auratus
VPLWGS

SEQ ID NO: 270 - protein, 6 aa, Canis familiaris
VATRNS

SEQ ID NO: 271 - protein, 6 aa, Canis lupus
VATRNS

SEQ ID NO: 272 - protein, 6 aa, Canis latrans
VATRNS

SEQ ID NO: 273 - protein, 6 aa, Ovis aries
VRLHES

SEQ ID NO: 274 - protein, 6 aa, Carassius auratus
IPHQQS

SEQ ID NO: 275 - protein, 6 aa, Carassius auratus
IPHQQS

SEQ ID NO: 276 - protein, 6 aa, Coturnix coturnix japonica
VRLLES

SEQ ID NO: 277 - protein, 6 aa, Sus scrofa
VRLHES

SEQ ID NO: 278 - protein, 6 aa, Gallus gallus
VRLLES

SEQ ID NO: 279 - protein, 6 aa, Rattus norvegicus
VRLHES

SEQ ID NO: 280 - protein, 6 aa, Gallus gallus
VRLLES

SEQ ID NO: 281 - protein, 6 aa, Amaranthus hypochondriacus
IPKWNR

SEQ ID NO: 282 - protein, 6 aa, Agriosphodrus dohrni
LPRGSK

SEQ ID NO: 283 - protein, 6 aa, Isyndus obscurs
LPRGSK

SEQ ID NO: 284 - protein, 6 aa, Peirates turpis
IAPGAP

SEQ ID NO: 285 - protein, 6 aa, Conus vexillum
QRANFV

SEQ ID NO: 286 - protein, 6 aa, Conus abbreviates
SPPGSY

SEQ ID NO: 287 - protein, 6 aa, Conus abbreviates
TPPGGA

SEQ ID NO: 288 - protein, 6 aa, Conus abbreviates
TPPGGA

SEQ ID NO: 289 - protein, 6 aa, Conus abbreviates
TPRHGV

SEQ ID NO: 290 - protein, 6 aa, Conus abbreviates
TPPEVG

SEQ ID NO: 291 - protein, 6 aa, Conus abbreviates
TPPGGY

SEQ ID NO: 292 - protein, 6 aa, Conus abbreviates
TPPGGY

SEQ ID NO: 293 - protein, 6 aa, Conus abbreviates
TAPGGA

SEQ ID NO: 294 - protein, 6 aa, Conus abbreviates
TAPGGA

SEQ ID NO: 295 - protein, 6 aa, Conus abbreviates
TPAGDA

SEQ ID NO: 296 - protein, 6 aa, Conus abbreviates
TPAGDA

SEQ ID NO: 297 - protein, 6 aa, Conus abbreviates
TPAGDA

SEQ ID NO: 298 - protein, 6 aa, Conus abbreviates
TPAGGA

SEQ ID NO: 299 - protein, 6 aa, Conus abbreviates
TPGGEA

SEQ ID NO: 300 - protein, 6 aa, Conus abbreviates
LGSGEL

SEQ ID NO: 301 - protein, 6 aa, Conus abbreviates
LGSREQ

SEQ ID NO: 302 - protein, 6 aa, Conus abbreviates
LGSREL

SEQ ID NO: 303 - protein, 6 aa, Conus aurisiacus
SNAGAF

SEQ ID NO: 304 - protein, 6 aa, Conus ammiralis
KQSGEM

SEQ ID NO: 305 - protein, 6 aa, Conus ammiralis
TQSGEL

SEQ ID NO: 306 - protein, 6 aa, Conus ammiralis
YDGGTS

SEQ ID NO: 307 - protein, 6 aa, Conus amadis
KQAGES

SEQ ID NO: 308 - protein, 6 aa, Conus arenatus
LEKGVL

SEQ ID NO: 309 - protein, 6 aa, Conus arenatus
ADLGEE

SEQ ID NO: 310 - protein, 6 aa, Conus arenatus
GEQGEG

SEQ ID NO: 311 - protein, 6 aa, Conus arenatus
GNLGES

SEQ ID NO: 312 - protein, 6 aa, Conus arenatus
SNFGSD

SEQ ID NO: 313 - protein, 6 aa, Conus arenatus
TPVGGY

SEQ ID NO: 314 - protein, 6 aa, Conus arenatus
TPVGGY

SEQ ID NO: 315 - protein, 6 aa, Conus arenatus
TPVGGY

SEQ ID NO: 316 - protein, 6 aa, Conus arenatus
TPVGGS

SEQ ID NO: 317 - protein, 6 aa, Conus arenatus
SPNGGS

SEQ ID NO: 318 - protein, 6 aa, Conus arenatus
TVDSDF

SEQ ID NO: 319 - protein, 6 aa, Conus arenatus
VDGGTF

SEQ ID NO: 320 - protein, 3 aa, Conus arenatus
EES

SEQ ID NO: 321 - protein, 3 aa, Conus arenatus
EEY

SEQ ID NO: 322 - protein, 3 aa, Conus arenatus
EEY

SEQ ID NO: 323 - protein, 3 aa, Conus arenatus
EEY

SEQ ID NO: 324 - protein, 3 aa, Conus arenatus
EES

SEQ ID NO: 325 - protein, 3 aa, Conus arenatus
EEN

SEQ ID NO: 326 - protein, 3 aa, Conus arenatus
EES

SEQ ID NO: 327 - protein, 3 aa, Conus arenatus
EES

SEQ ID NO: 328 - protein, 6 aa, Conus arenatus
RALGEY

SEQ ID NO: 329 - protein, 6 aa, Conus arenatus
LPPLSL

SEQ ID NO: 330 - protein, 6 aa, Conus arenatus
LPPLSL

SEQ ID NO: 331 - protein, 6 aa, Conus arenatus
LPPLSL

SEQ ID NO: 332 - protein, 6 aa, Conus arenatus
LPPLHW

SEQ ID NO: 333 - protein, 6 aa, Conus arenatus
LPPLSL

SEQ ID NO: 334 - protein, 6 aa, Conus arenatus
ADLGEE

SEQ ID NO: 335 - protein, 6 aa, Conus austini
KQKGEG

SEQ ID NO: 336 - protein, 6 aa, Conus Aristophanes
TPPGTY

SEQ ID NO: 337 - protein, 6 aa, Conus Aristophanes
TPPSGY

SEQ ID NO: 338 - protein, 6 aa, Conus Aristophanes
THAYEA

SEQ ID NO: 339 - protein, 6 aa, Conus Aristophanes
TSPDGA

SEQ ID NO: 340 - protein, 6 aa, Conus Aristophanes
THPGGA

SEQ ID NO: 341 - protein, 6 aa, Conus Aristophanes
TPPGGA

SEQ ID NO: 342 - protein, 6 aa, Conus Aristophanes
TPPEGA

SEQ ID NO: 343 - protein, 6 aa, Conus Aristophanes
TPPEGY

SEQ ID NO: 344 - protein, 6 aa, Conus aulicus
KAENEL

SEQ ID NO: 345 - protein, 6 aa, Conus aulicus
LEFGEL

SEQ ID NO: 346 - protein, 6 aa, Conus aulicus
EPPGNF

SEQ ID NO: 347 - protein, 6 aa, Conus bullatus
SAPGAF

SEQ ID NO: 348 - protein, 6 aa, Conus betulinus
NDPGGS

SEQ ID NO: 349 - protein, 6 aa, Conus betulinus
KGWSVY

SEQ ID NO: 350 - protein, 3 aa, Conus radiates
EET

SEQ ID NO: 351 - protein, 6 aa, Conus catus
SNAGAF

SEQ ID NO: 352 - protein, 6 aa, Conus catus
KGKGAS

SEQ ID NO: 353 - protein, 6 aa, Conus catus
KGKGAS

SEQ ID NO: 354 - protein, 6 aa, Conus catus
KSTGAS

SEQ ID NO: 355 - protein, 6 aa, Conus catus
QGRGAS

SEQ ID NO: 356 - protein, 6 aa, Conus catus
QGRGAS

SEQ ID NO: 357 - protein, 6 aa, Conus catus
KSTGAS

SEQ ID NO: 358 - protein, 6 aa, Conus catus
QGRGAS

SEQ ID NO: 359 - protein, 6 aa, Conus catus
KSTGAS

SEQ ID NO: 360 - protein, 6 aa, Conus catus
KGKGAS

SEQ ID NO: 361 - protein, 6 aa, Conus catus
KGKGQS

SEQ ID NO: 362 - protein, 6 aa, Conus catus
KSKGAK

SEQ ID NO: 363 - protein, 6 aa, Conus catus
SNAGAF

SEQ ID NO: 364 - protein, 6 aa, Conus caracteristicus
VDPGEF

SEQ ID NO: 365 - protein, 3 aa, Conus caracteristicus
EED

SEQ ID NO: 366 - protein, 6 aa, Conus capitaneus
REQSQG

SEQ ID NO: 367 - protein, 6 aa, Conus consors
YNAGTF

SEQ ID NO: 368 - protein, 6 aa, Conus consors
YSTGTF

SEQ ID NO: 369 - protein, 6 aa, Conus consors
KGKGAP

SEQ ID NO: 370 - protein, 6 aa, Conus coronatus
TPPGSH

SEQ ID NO: 371 - protein, 6 aa, Conus coronatus
TPRNGV

SEQ ID NO: 372 - protein, 6 aa, Conus coronatus
TSPGGA

SEQ ID NO: 373 - protein, 6 aa, Conus coronatus
MHPEGG

SEQ ID NO: 374 - protein, 6 aa, Conus coronatus
TPAGKA

SEQ ID NO: 375 - protein, 6 aa, Conus coronatus
TDPGGA

SEQ ID NO: 376 - protein, 6 aa, Conus coronatus
RLPGDL

SEQ ID NO: 377 - protein, 6 aa, Conus virgo
DEEGTG

SEQ ID NO: 378 - protein, 6 aa, Conus virgo
GGQGEG

SEQ ID NO: 379 - protein, 6 aa, Conus virgo
GGQGKG

SEQ ID NO: 380 - protein, 6 aa, Conus virgo
RPSGSP

SEQ ID NO: 381 - protein, 6 aa, Conus virgo
GGQGEG

SEQ ID NO: 382 - protein, 6 aa, Conus virgo
IADDMP

SEQ ID NO: 383 - protein, 6 aa, Conus virgo
ESYGKP

SEQ ID NO: 384 - protein, 6 aa, Conus virgo
REGGEF

SEQ ID NO: 385 - protein, 6 aa, Conus virgo
REGGEF

SEQ ID NO: 386 - protein, 6 aa, Conus virgo
GGQGEG

SEQ ID NO: 387 - protein, 6 aa, Conus virgo
SSGGTF

SEQ ID NO: 388 - protein, 6 aa, Conus ventricosus
IAVGQL

SEQ ID NO: 389 - protein, 6 aa, Conus dalli
RKEHQL

SEQ ID NO: 390 - protein, 6 aa, Conus dalli
SEEGQL

SEQ ID NO: 391 - protein, 6 aa, Conus dalli
LGGGEV

SEQ ID NO: 392 - protein, 6 aa, Conus dalli
AQSSEL

SEQ ID NO: 393 - protein, 6 aa, Conus dalli
YDGGTG

SEQ ID NO: 394 - protein, 6 aa, Conus dalli
QEKWDY

SEQ ID NO: 395 - protein, 6 aa, Conus dalli
QGEWEF

SEQ ID NO: 396 - protein, 6 aa, Conus delessertii
IPGGEN

SEQ ID NO: 397 - protein, 6 aa, Conus delessertii
KPKNNL

SEQ ID NO: 398 - protein, 6 aa, Conus distans
LGFGEA

SEQ ID NO: 399 - protein, 6 aa, Conus distans
YLLVHF

SEQ ID NO: 400 - protein, 6 aa, Conus distans
NEAQEH

SEQ ID NO: 401 - protein, 6 aa, Conus ermineus
KPKGRK

SEQ ID NO: 402 - protein, 6 aa, Conus ermineus
TPHGGS

SEQ ID NO: 403 - protein, 6 aa, Conus ermineus
  misc_feature (3)..(3): Xaa can be any naturally occurring amino acid
IKXYGF

SEQ ID NO: 404 - protein, 6 aa, Conus ermineus
YPPGTF

SEQ ID NO: 405 - protein, 6 aa, Conus ebraeus
THSGGA

SEQ ID NO: 406 - protein, 6 aa, Conus ebraeus
TRSGGA

SEQ ID NO: 407 - protein, 6 aa, Conus ebraeus
TRSGGA

SEQ ID NO: 408 - protein, 6 aa, Conus ebraeus
TRSGGA

SEQ ID NO: 409 - protein, 6 aa, Conus ebraeus
TQTNGA

SEQ ID NO: 410 - protein, 6 aa, Conus ebraeus
AHSGGA

SEQ ID NO: 411 - protein, 6 aa, Conus ebraeus
THSGGA

SEQ ID NO: 412 - protein, 6 aa, Conus ebraeus
THSGGA

SEQ ID NO: 413 - protein, 6 aa, Conus ebraeus
TRSGGA

SEQ ID NO: 414 - protein, 6 aa, Conus ebraeus
THSGGA

SEQ ID NO: 415 - protein, 6 aa, Conus ebraeus
THSGGA

SEQ ID NO: 416 - protein, 6 aa, Conus ebraeus
TRSGGA

SEQ ID NO: 417 - protein, 6 aa, Conus episcopatus
LGFGEA

SEQ ID NO: 418 - protein, 6 aa, Conus geographus
EPPGDF

SEQ ID NO: 419 - protein, 6 aa, Conus geographus
KSPGSS

SEQ ID NO: 420 - protein, 6 aa, Conus geographus
KSPGTP

SEQ ID NO: 421 - protein, 6 aa, Conus geographus
KSPGTP

SEQ ID NO: 422 - protein, 6 aa, Conus generalis
LDPGYF

SEQ ID NO: 423 - protein, 6 aa, Conus textile
KDGLTT

SEQ ID NO: 424 - protein, 6 aa, Conus textile
SDDWQY

SEQ ID NO: 425 - protein, 6 aa, Conus textile
SDDWQY

SEQ ID NO: 426 - protein, 6 aa, Conus textile
PDYTEP

SEQ ID NO: 427 - protein, 6 aa, Conus gloriamaris
RLGAES

SEQ ID NO: 428 - protein, 6 aa, Conus gloriamaris
KQADES

SEQ ID NO: 429 - protein, 6 aa, Conus gloriamaris
VPYEGP

SEQ ID NO: 430 - protein, 6 aa, Conus gloriamaris
YDGGTG

SEQ ID NO: 431 - protein, 6 aa, Conus gloriamaris
QALWDY

SEQ ID NO: 432 - protein, 6 aa, Conus gloriamaris
RKEGQL

SEQ ID NO: 433 - protein, 4 aa, Conus imperialis
DPYY

SEQ ID NO: 434 - protein, 6 aa, Conus judaeus
TRPGGA

SEQ ID NO: 435 - protein, 6 aa, Conus judaeus
TPPGGA

SEQ ID NO: 436 - protein, 6 aa, Conus textile
IEQFDP

SEQ ID NO: 437 - protein, 6 aa, Conus textile
APFLHP

SEQ ID NO: 438 - protein, 6 aa, Conus lividus
TPRNGF

SEQ ID NO: 439 - protein, 6 aa, Conus litteratus
KDGLTT

SEQ ID NO: 440 - protein, 6 aa, Conus lividus
GHSGAG

SEQ ID NO: 441 - protein, 6 aa, Conus lividus
TAPSGY

SEQ ID NO: 442 - protein, 3 aa, Conus lividus
NEY

SEQ ID NO: 443 - protein, 6 aa, Conus lividus
DPPGDS

SEQ ID NO: 444 - protein, 6 aa, Conus leopardus
VELGEI

SEQ ID NO: 445 - protein, 6 aa, Conus litteratus
TDWLGS

SEQ ID NO: 446 - protein, 6 aa, Conus litteratus
AYISEP

SEQ ID NO: 447 - protein, 6 aa, Conus litteratus
SSPDES

SEQ ID NO: 448 - protein, 6 aa, Conus litteratus
KVAGSP

SEQ ID NO: 449 - protein, 6 aa, Conus litteratus
TDEGGD

SEQ ID NO: 450 - protein, 6 aa, Conus litteratus
TDEGGD

SEQ ID NO: 451 - protein, 6 aa, Conus litteratus
LGWSNY

SEQ ID NO: 452 - protein, 6 aa, Conus lividus
PNTGEL

SEQ ID NO: 453 - protein, 6 aa, Conus lividus
SPAGEV

SEQ ID NO: 454 - protein, 6 aa, Conus lividus
SPAGEV

SEQ ID NO: 455 - protein, 6 aa, Conus lividus
SPGGEV

SEQ ID NO: 456 - protein, 6 aa, Conus lividus
SPGGEV

SEQ ID NO: 457 - protein, 6 aa, Conus lividus
SPGGEV

SEQ ID NO: 458 - protein, 6 aa, Conus lividus
TPRNGF

SEQ ID NO: 459 - protein, 6 aa, Conus lividus
TPRNGA

SEQ ID NO: 460 - protein, 6 aa, Conus miliaris
TPSGGA

SEQ ID NO: 461 - protein, 6 aa, Conus miliaris
TPRHGV

SEQ ID NO: 462 - protein, 6 aa, Conus miliaris
TPPGGS

SEQ ID NO: 463 - protein, 6 aa, Conus miliaris
LGSGEQ

SEQ ID NO: 464 - protein, 6 aa, Conus miliaris
SPPGSY

SEQ ID NO: 465 - protein, 6 aa, Conus miliaris
TPPEGG

SEQ ID NO: 466 - protein, 6 aa, Conus miliaris
TPAGDA

SEQ ID NO: 467 - protein, 6 aa, Conus magus
KQADEP

SEQ ID NO: 468 - protein, 6 aa, Conus magus
YNAGTF

SEQ ID NO: 469 - protein, 6 aa, Conus magus
YNAGTF

SEQ ID NO: 470 - protein, 6 aa, Conus magus
YNAGSF

SEQ ID NO: 471 - protein, 6 aa, Conus magus
YPPGTF

SEQ ID NO: 472 - protein, 6 aa, Conus magus
YNAGTF

SEQ ID NO: 473 - protein, 6 aa, Conus magus
KGKGAK

SEQ ID NO: 474 - protein, 6 aa, Conus magus
KGKGAS

SEQ ID NO: 475 - protein, 6 aa, Conus magus
KGKGAP

SEQ ID NO: 476 - protein, 6 aa, Conus magus
QGRGAS

SEQ ID NO: 477 - protein, 6 aa, Conus marmoreus
EDVWMP

SEQ ID NO: 478 - protein, 6 aa, Conus marmoreus
EPPGDF

SEQ ID NO: 479 - protein, 6 aa, Conus marmoreus
RPPGMV

SEQ ID NO: 480 - protein, 6 aa, Conus marmoreus
LDGGEI

SEQ ID NO: 481 - protein, 6 aa, Conus marmoreus
LEADYY

SEQ ID NO: 482 - protein, 6 aa, Conus marmoreus
LESGSL

SEQ ID NO: 483 - protein, 6 aa, Conus magus
NNRGGG

SEQ ID NO: 484 - protein, 6 aa, Conus magus
DPKWTI

SEQ ID NO: 485 - protein, 6 aa, Conus magus
NNRGGG

SEQ ID NO: 486 - protein, 6 aa, Conus magus
KGKGAG

SEQ ID NO: 487 - protein, 6 aa, Conus miles
KHQNDS

SEQ ID NO: 488 - protein, 6 aa, Conus miles
NDRGGG

SEQ ID NO: 489 - protein, 6 aa, Conus miles
REKGQG

SEQ ID NO: 490 - protein, 6 aa, Conus miles
RSSGRY

SEQ ID NO: 491 - protein, 6 aa, Conus miles
DAPNAP

SEQ ID NO: 492 - protein, 6 aa, Conus miliaris
TPPGSD

SEQ ID NO: 493 - protein, 6 aa, Conus miliaris
TPRNGY

SEQ ID NO: 494 - protein, 6 aa, Conus miliaris
TPSGGA

SEQ ID NO: 495 - protein, 6 aa, Conus miliaris
ADGGDL

SEQ ID NO: 496 - protein, 6 aa, Conus miliaris
LDAGEM

SEQ ID NO: 497 - protein, 6 aa, Conus miliaris
PNTGEL

SEQ ID NO: 498 - protein, 6 aa, Conus miliaris
PNTGEL

SEQ ID NO: 499 - protein, 6 aa, Conus marmoreus
RKKWEY

SEQ ID NO: 500 - protein, 6 aa, Conus marmoreus
SKKWEY

SEQ ID NO: 501 - protein, 6 aa, Conus nigropunctatus
FSPGTF

SEQ ID NO: 502 - protein, 6 aa, Conus omaria
VPHEGP

SEQ ID NO: 503 - protein, 6 aa, Conus omaria
LAEHET

SEQ ID NO: 504 - protein, 6 aa, Conus omaria
IPHFDP

SEQ ID NO: 505 - protein, 6 aa, Conus omaria
LGFGEA

SEQ ID NO: 506 - protein, 6 aa, Conus omaria
EPPGNF

SEQ ID NO: 507 - protein, 6 aa, Conus omaria
QRRWDF

SEQ ID NO: 508 - protein, 6 aa, Conus purpurascens
KTPGRK

SEQ ID NO: 509 - protein, 6 aa, Conus purpurascens
KKSGRK

SEQ ID NO: 510 - protein, 6 aa, Conus purpurascens
KKTGRK

SEQ ID NO: 511 - protein, 6 aa, Conus purpurascens
YPPGTF

SEQ ID NO: 512 - protein, 6 aa, Conus purpurascens
YAPGTF

SEQ ID NO: 513 - protein, 6 aa, Conus purpurascens
RIPNQK

SEQ ID NO: 514 - protein, 6 aa, Conus pennaceus
VKYLDP

SEQ ID NO: 515 - protein, 3 aa, Conus pennaceus
EES

SEQ ID NO: 516 - protein, 3 aa, Conus pennaceus
EEY

SEQ ID NO: 517 - protein, 6 aa, Conus pennaceus
FESWVA

SEQ ID NO: 518 - protein, 6 aa, Conus pennaceus
IAESEP

SEQ ID NO: 519 - protein, 6 aa, Conus pennaceus
QRRWDF

SEQ ID NO: 520 - protein, 6 aa, Conus pennaceus
LGFGEV

SEQ ID NO: 521 - protein, 6 aa, Conus pennaceus
IPQFDP

SEQ ID NO: 522 - protein, 6 aa, Conus pennaceus
KAESEA

SEQ ID NO: 523 - protein, 6 aa, Conus pennaceus
FESWVA

SEQ ID NO: 524 - protein, 6 aa, Conus pennaceus
LEVDYF

SEQ ID NO: 525 - protein, 6 aa, Conus pennaceus
SDQWKS

SEQ ID NO: 526 - protein, 6 aa, Conus pennaceus
DDWLAA

SEQ ID NO: 527 - protein, 6 aa, Conus pennaceus
LEVDYF

SEQ ID NO: 528 - protein, 6 aa, Conus pennaceus
EPPGNF

SEQ ID NO: 529 - protein, 6 aa, Conus pennaceus
TSWFGR

SEQ ID NO: 530 - protein, 6 aa, Conus pulicarius
VEDGDF

SEQ ID NO: 531 - protein, 6 aa, Conus pulicarius
RPVGQY

SEQ ID NO: 532 - protein, 6 aa, Conus pulicarius
NTPTQY

SEQ ID NO: 533 - protein, 6 aa, Conus quercinus
AAAGEA

SEQ ID NO: 534 - protein, 6 aa, Conus quercinus
QDSGVV

SEQ ID NO: 535 - protein, 2 aa, Conus quercinus
PW

SEQ ID NO: 536 - protein, 6 aa, Conus radiates
KPPGSP

SEQ ID NO: 537 - protein, 6 aa, Conus radiates
TYWLGP

SEQ ID NO: 538 - protein, 6 aa, Conus striatus
KAAGKS

SEQ ID NO: 539 - protein, 6 aa, Conus striatus
TPDDGA

SEQ ID NO: 540 - protein, 6 aa, Conus striatus
RTWNAP

SEQ ID NO: 541 - protein, 6 aa, Conus striatus
RSSGSP

SEQ ID NO: 542 - protein, 6 aa, Conus striatus
KGKGAP

SEQ ID NO: 543 - protein, 6 aa, Conus striatus
MEAGSY

SEQ ID NO: 544 - protein, 6 aa, Conus striatus
SNAGGF

SEQ ID NO: 545 - protein, 6 aa, Conus striatus
KAAGKP

SEQ ID NO: 546 - protein, 6 aa, Conus striatus
IEAGNY

SEQ ID NO: 547 - protein, 6 aa, Conus striatus
MEAGSY

SEQ ID NO: 548 - protein, 6 aa, Conus striatus
RSSGSP

SEQ ID NO: 549 - protein, 6 aa, Conus striatus
RPSGSP

SEQ ID NO: 550 - protein, 6 aa, Conus striatus
KLKGQS

SEQ ID NO: 551 - protein, 6 aa, Conus striatus
SSGGTF

SEQ ID NO: 552 - protein, 6 aa, Conus stercusmuscarum
SSGGTF

SEQ ID NO: 553 - protein, 6 aa, Conus spurius
LQFGST

SEQ ID NO: 554 - protein, 6 aa, Conus striolatus
YPPGTF

SEQ ID NO: 555 - protein, 6 aa, Conus striolatus
YSTGTF

SEQ ID NO: 556 - protein, 6 aa, Conus striolatus
MKAGSY

SEQ ID NO: 557 - protein, 6 aa, Conus tulipa
LSPGSS

SEQ ID NO: 558 - protein, 6 aa, Conus tulipa
SGRDSR

SEQ ID NO: 559 - protein, 6 aa, Conus textile
MLWFGR

SEQ ID NO: 560 - protein, 2 aa, Conus textile
PY

SEQ ID NO: 561 - protein, 6 aa, Conus tessulatus
WPQYWF

SEQ ID NO: 562 - protein, 6 aa, Conus tessulatus
SGWSVY

SEQ ID NO: 563 - protein, 6 aa, Conus tessulatus
TPWLGG

SEQ ID NO: 564 - protein, 3 aa, Conus tessulatus
NEY

SEQ ID NO: 565 - protein, 3 aa, Conus tessulatus
NEH

SEQ ID NO: 566 - protein, 3 aa, Conus tessulatus
NEY

SEQ ID NO: 567 - protein, 3 aa, Conus tessulatus
DEY

SEQ ID NO: 568 - protein, 6 aa, Conus textile
RKEHQL

SEQ ID NO: 569 - protein, 6 aa, Conus textile
APFLHL

SEQ ID NO: 570 - protein, 6 aa, Conus textile
YDSGTS

SEQ ID NO: 571 - protein, 6 aa, Conus textile
EPPGNF

SEQ ID NO: 572 - protein, 6 aa, Conus textile
KQSGEM

SEQ ID NO: 573 - protein, 6 aa, Conus textile
KQSGEM

SEQ ID NO: 574 - protein, 6 aa, Conus textile
KDGLTT

SEQ ID NO: 575 - protein, 6 aa, Conus textile
TSWLAT

SEQ ID NO: 576 - protein, 6 aa, Conus textile
MAWFGL

SEQ ID NO: 577 - protein, 6 aa, Conus textile
GIWFSR

SEQ ID NO: 578 - protein, 6 aa, Conus textile
RGYDAP

SEQ ID NO: 579 - protein, 6 aa, Conus textile
KQSGEM

SEQ ID NO: 580 - protein, 6 aa, Conus textile
LDAGEI

SEQ ID NO: 581 - protein, 6 aa, Conus textile
IEQFDP

SEQ ID NO: 582 - protein, 6 aa, Conus textile
YDGGTS

SEQ ID NO: 583 - protein, 6 aa, Conus textile
QEKWDF

SEQ ID NO: 584 - protein, 6 aa, Conus textile
LDAGEV

SEQ ID NO: 585 - protein, 6 aa, Conus textile
YDSGTS

SEQ ID NO: 586 - protein, 6 aa, Conus textile
YDGGTS

SEQ ID NO: 587 - protein, 6 aa, Conus textile
EPPGNF

SEQ ID NO: 588 - protein, 6 aa, Conus textile
VPYEGP

SEQ ID NO: 589 - protein, 6 aa, Conus textile
QEKWDY

SEQ ID NO: 590 - protein, 6 aa, Conus textile
KQADEP

SEQ ID NO: 591 - protein, 6 aa, Conus textile
GGYSTY

SEQ ID NO: 592 - protein, 6 aa, Conus victoriae
YGFGEA

SEQ ID NO: 593 - protein, 6 aa, Conus victoriae
EPPGNF

SEQ ID NO: 594 - protein, 6 aa, Conus victoriae
YDGGTG

SEQ ID NO: 595 - protein, 6 aa, Conus victoriae
LSGGEV

SEQ ID NO: 596 - protein, 6 aa, Conus victoriae
HEEGQL

SEQ ID NO: 597 - protein, 6 aa, Conus victoriae
IPFLHP

SEQ ID NO: 598 - protein, 6 aa, Conus vexillum
RLWSNG

SEQ ID NO: 599 - protein, 6 aa, Conus virgo
RRRGQG

SEQ ID NO: 600 - protein, 6 aa, Conus virgo
LDPGYF

SEQ ID NO: 601 - protein, 6 aa, Conus ventricosus
SGWSVY

SEQ ID NO: 602 - protein, 6 aa, Conus ventricosus
RPGGMI

SEQ ID NO: 603 - protein, 6 aa, Conus ventricosus
EAGGRF

SEQ ID NO: 604 - protein, 6 aa, Conus ventricosus
IEDKKY

SEQ ID NO: 605 - protein, 6 aa, Conus ventricosus
RQPGEF

SEQ ID NO: 606 - protein, 6 aa, Conus ventricosus
LASGET

SEQ ID NO: 607 - protein, 6 aa, Conus ventricosus
LGSGET

SEQ ID NO: 608 - protein, 6 aa, Conus ventricosus
SGSGYG

SEQ ID NO: 609 - protein, 6 aa, Conus ventricosus
SGSGYG

SEQ ID NO: 610 - protein, 4 aa, Conus ventricosus
STAG

SEQ ID NO: 611 - protein, 3 aa, Conus ventricosus
EEY

SEQ ID NO: 612 - protein, 6 aa, Conus ventricosus
SGWSVH

SEQ ID NO: 613 - protein, 3 aa, Conus ventricosus
KEY

SEQ ID NO: 614 - protein, 3 aa, Conus ventricosus
YEY

SEQ ID NO: 615 - protein, 3 aa, Conus ventricosus
EEY

SEQ ID NO: 616 - protein, 6 aa, Conus ventricosus
RGWSNG

SEQ ID NO: 617 - protein, 6 aa, Conus ventricosus
TGWLDG

SEQ ID NO: 618 - protein, 6 aa, Conus ventricosus
RTWYAP

SEQ ID NO: 619 - protein, 6 aa, Conus ventricosus
VGLSSY

SEQ ID NO: 620 - protein, 6 aa, Conus ventricosus
VGWSSY

SEQ ID NO: 621 - protein, 6 aa, Conus ventricosus
VAGGHF

SEQ ID NO: 622 - protein, 6 aa, Conus ventricosus
AAGGQF

SEQ ID NO: 623 - protein, 6 aa, Conus vexillum
NNRGGG

SEQ ID NO: 624 - protein, 6 aa, Conus vexillum
TDDSQF

SEQ ID NO: 625 - protein, 6 aa, Conus geographus
SGRGSR

SEQ ID NO: 626 - protein, 6 aa, Conus arenatus
SRRGHR

SEQ ID NO: 627 - protein, 6 aa, Conus aulicus
SWPGQE

SEQ ID NO: 628 - protein, 6 aa, Conus betulinus
RAEGTY

SEQ ID NO: 629 - protein, 6 aa, Conus betulinus
LSLGQR

SEQ ID NO: 630 - protein, 6 aa, Conus betulinus
LSLGQR

SEQ ID NO: 631 - protein, 6 aa, Conus capitaneus
FPPGVY

SEQ ID NO: 632 - protein, 6 aa, Conus emaciatus
FPPGIY

SEQ ID NO: 633 - protein, 6 aa, Conus episcopatus
SGIGQG

SEQ ID NO: 634 - protein, 6 aa, Conus episcopatus
LSEGSP

SEQ ID NO: 635 - protein, 6 aa, Conus figulinus
HHEGLP

SEQ ID NO: 636 - protein, 6 aa, Conus figulinus
GKDGRA

SEQ ID NO: 637 - protein, 6 aa, Conus figulinus
KKDRKP

SEQ ID NO: 638 - protein, 6 aa, Conus figulinus
KADEEP

SEQ ID NO: 639 - protein, 6 aa, Conus imperialis
LRDGQS

SEQ ID NO: 640 - protein, 6 aa, Conus imperialis
RLEGSS

SEQ ID NO: 641 - protein, 6 aa, Conus imperialis
TSEGYS

SEQ ID NO: 642 - protein, 6 aa, Conus lynceus
SGSGEG

SEQ ID NO: 643 - protein, 6 aa, Conus magus
GKDGRQ

SEQ ID NO: 644 - protein, 6 aa, Conus magus
SNKGQQ

SEQ ID NO: 645 - protein, 6 aa, Conus magus
GKDGRK

SEQ ID NO: 646 - protein, 6 aa, Conus miles
FPPGTF

SEQ ID NO: 647 - protein, 6 aa, Conus radiates
GKDGRK

SEQ ID NO: 648 - protein, 6 aa, Conus radiates
GKDGRK

SEQ ID NO: 649 - protein, 6 aa, Conus radiates
GKDGRA

SEQ ID NO: 650 - protein, 6 aa, Conus radiates
GKDRRK

SEQ ID NO: 651 - protein, 6 aa, Conus radiates
GKDGRK

SEQ ID NO: 652 - protein, 6 aa, Conus radiates
GKDGRK

SEQ ID NO: 653 - protein, 6 aa, Conus radiates
GKDGRK

SEQ ID NO: 654 - protein, 6 aa, Conus radiates
KANGKP

SEQ ID NO: 655 - protein, 6 aa, Conus radiates
GKDGRQ

SEQ ID NO: 656 - protein, 6 aa, Conus radiates
GKDGRQ

SEQ ID NO: 657 - protein, 6 aa, Conus radiates
WVGRVH

SEQ ID NO: 658 - protein, 6 aa, Conus radiates
GKDGRQ

SEQ ID NO: 659 - protein, 6 aa, Conus radiates
KADEKP

SEQ ID NO: 660 - protein, 6 aa, Conus radiates
KADEKP

SEQ ID NO: 661 - protein, 6 aa, Conus radiates
KANGKP

SEQ ID NO: 662 - protein, 6 aa, Conus radiates
KADEKP

SEQ ID NO: 663 - protein, 6 aa, Conus radiates
KKDRKP

SEQ ID NO: 664 - protein, 6 aa, Conus radiates
KTNKMS

SEQ ID NO: 665 - protein, 6 aa, Conus regius
QAYGES

SEQ ID NO: 666 - protein, 6 aa, Conus striatus
KKDRKP

SEQ ID NO: 667 - protein, 6 aa, Conus striatus
VPPSRY

SEQ ID NO: 668 - protein, 6 aa, Conus spurius
RTEGMS

SEQ ID NO: 669 - protein, 6 aa, Conus striolatus
RAEGTY

SEQ ID NO: 670 - protein, 6 aa, Conus textile
IPEGSS

SEQ ID NO: 671 - protein, 6 aa, Conus virgo
FPPGIY

SEQ ID NO: 672 - protein, 6 aa, Conus vexillum
FPPGIY

SEQ ID NO: 673 - protein, 6 aa, Conus vexillum
FPPGIY

SEQ ID NO: 674 - protein, 3 aa, Cladosporium fulvum
NSS

SEQ ID NO: 675 - protein, 3 aa, Aspergillus clavatus
GQL

SEQ ID NO: 676 - protein, 3 aa, Aspergillus terreus
GQV

SEQ ID NO: 677 - protein, 3 aa, Neosartorya fischeri
GQV

SEQ ID NO: 678 - protein, 6 aa, Botryotinia fuckeliana
IAKGEV

SEQ ID NO: 679 - protein, 6 aa, Botryotinia fuckeliana
LPQGES

SEQ ID NO: 680 - protein, 6 aa, Sclerotinia sclerotiorium
IKNGEV

SEQ ID NO: 681 - protein, 6 aa, Laccaria bicolor
LGRDHD

SEQ ID NO: 682 - protein, 6 aa, Laccaria bicolor
VTKGKI

SEQ ID NO: 683 - protein, 6 aa, Laccaria bicolor
FIALTP

SEQ ID NO: 684 - protein, 6 aa, Laccaria bicolor
LMDGSY

SEQ ID NO: 685 - protein, 6 aa, Laccaria bicolor
YVRGDY

SEQ ID NO: 686 - protein, 6 aa, Laccaria bicolor
FGLGSP

SEQ ID NO: 687 - protein, 6 aa, Laccaria bicolor
FALGTL

SEQ ID NO: 688 - protein, 6 aa, Chaetomium globosum
HSILTS

SEQ ID NO: 689 - protein, 6 aa, Neurospora crassa
RAILTT

SEQ ID NO: 690 - protein, 28 aa, Astyanax mexicanus
RRHSLYVDFSDVGWNDWIVAPPGYHAFY

SEQ ID NO: 691 - protein, 28 aa, Astyanax mexicanus
RRHPLYVDFSDVGWNEWIVAPPGYHAFY

SEQ ID NO: 692 - protein, 28 aa, Astyanax mexicanus
RRHALYVDFSDVGWNDWIVAPPGYQAYY

SEQ ID NO: 693 - protein, 28 aa, Astyanax mexicanus
KRHVLYVDFSDVGWNEWIVAPPGYDAFY

SEQ ID NO: 694 - protein, 28 aa, Astyanax mexicanus
RRHTLYVDFSDVGWNDWIVAPPGYQAYY

SEQ ID NO: 695 - protein, 28 aa, Paracentrotus lividus
RRHPLYVDFSDVHWNDWIVAPAGYQAYY

SEQ ID NO: 696 - protein, 28 aa, Paracentrotus lividus
QRHRLFVSFRDVGWEDWIIAPMGYQAYY

SEQ ID NO: 697 - protein, 28 aa, Sparus aurata
KRHALYVDFSDVGWNEWIVAPPGYHAFY

SEQ ID NO: 698 - protein, 30 aa, Sparus aurata
QVREILVDIFQEYPEEVEYIFKPSCVPLMR

SEQ ID NO: 699 - protein, 30 aa, Homo sapiens
HPIETLVDIFQEYPDEIEYIFKPSCVPLMR

SEQ ID NO: 700 - protein, 28 aa, Homo sapiens
SRKPLHVNFKELGWDDWIIAPLEYEAYH

SEQ ID NO: 701 - protein, 28 aa, Homo sapiens
SRKALHVNFKDMGWDDWIIAPLEYEAFH

SEQ ID NO: 702 - protein, 28 aa, Homo sapiens
KKHELYVSFRDLGWQDWIIAPEGYAAYY

SEQ ID NO: 703 - protein, 28 aa, Paralabidochromis chilotes
RRHALYVDFSDVGWNDWIVAPPGYQAYY

SEQ ID NO: 704 - protein, 30 aa, Danio rerio
RPREMLVEIQQEYPDDTEHIFIPSCVVLTR

SEQ ID NO: 705 - protein, 28 aa, Sus scrofa
KKHELYVSFRDLGWQDWIIAPEGYAAYY

SEQ ID NO: 706 - protein, 28 aa, Sus scrofa
KKHELYVSFRDLGWQDWIIAPEGYAAYY

SEQ ID NO: 707 - protein, 28 aa, Anas platyrhynchos
RRHALYVDFSDVGWNDWIVAPPGYQAFY

SEQ ID NO: 708 - protein, 28 aa, Anas platyrhynchos
RRHALYVDFSDVGWNDWIVAPPGYQAFY

SEQ ID NO: 709 - protein, 30 aa, Oryzias latipes
QPRELLVDILQEYPEEVEHIFIPSCVVLKR

SEQ ID NO: 710 - protein, 28 aa, Bos Taurus
KRHPLYVDFSDVGWNDWIVAPPGYHAFY

SEQ ID NO: 711 - protein, 28 aa, Capra hircus
RRHSLYVDFSDVGWNDWIVAPPGYQAFY

SEQ ID NO: 712 - protein, 28 aa, Bos Taurus
KRHPLYVDFSDVGWNDWIVAPPGYHAFY

SEQ ID NO: 713 - protein, 28 aa, Oryctolagus cuniculus
KKHELYVSFRDLGWQDWIIAPEGYAAYY

SEQ ID NO: 714 - protein, 28 aa, Sus scrofa
RRHSLYVDFSDVGWNDWIVAPPGYQAFY

SEQ ID NO: 715 - protein, 28 aa, Nematostella vectensis
QRQALHVSFRKLRWQDWVIAPEGYSAFY

SEQ ID NO: 716 - protein, 28 aa, Nematostella vectensis
QRHPLYVDFTDVGWNDWIVAPPGYHAFY

SEQ ID NO: 717 - protein, 28 aa, Nematostella vectensis
RRKRMYVDFRLLGWSDWIIAPQGYDAYL

SEQ ID NO: 718 - protein, 28 aa, Danio rerio
SKKPLHVNFRELGWDDWVIAPLDYEAYH

SEQ ID NO: 719 - protein, 28 aa, Homo sapiens
KKHELYVSFRDLGWQDWIIAPEGYAAYY

SEQ ID NO: 720 - protein, 28 aa, Homo sapiens
KKHELYVSFRDLGWQDWIIAPEGYAAFY

SEQ ID NO: 721 - protein, 28 aa, Sus scrofa
KKHELYVSFRDLGWQDWIIAPEGYAAYY

SEQ ID NO: 722 - protein, 28 aa, Ovis aries
RRHSLYVDFSDVGWNDWIVAPPGYQAFY

SEQ ID NO: 723 - protein, 28 aa, Xenopus tropicalis
RRHSLYVDFSDVGWNDWIVAPPGYQAFY

SEQ ID NO: 724 - protein, 30 aa, Xenopus tropicalis
QVREILVDIFQEYPDEVEYIFKPSCVPLMR

SEQ ID NO: 725 - protein, 28 aa, Papio anubis
RRHSLYVDFSDVGWNDWIVAPPGYQAFY

SEQ ID NO: 726 - protein, 28 aa, Papio anubis
SRKALHVNFKDMGWDDWIIAPLEYEAFH

SEQ ID NO: 727 - protein, 30 aa, Ovis aries
RPIETLVDIFQEYPDEIEFIFKPSCVPLMR

SEQ ID NO: 728 - protein, 28 aa, Callithrix jacchus
SRKALHVNFKDMGWDDWIIAPLEYEAFH

SEQ ID NO: 729 - protein, 30 aa, Sistrurus catenatus edwardsii
QTREMLVSILDEHPDEVAHLFRPSCVTVLR

SEQ ID NO: 730 - protein, 30 aa, Sistrurus catenatus edwardsii; identical to SEQ ID NO: 729

SEQ ID NO: 731 - protein, 28 aa, Culex quinquefasciatus
QRRPLYVDFSDVGWSDWIVAPPGYEAFY

SEQ ID NO: 732 - protein, 28 aa, Homo sapiens
KKHELYVSFRDLGWQDWIIAPEGYAAYY

SEQ ID NO: 733 - protein, 28 aa, Callicebus moloch
SRKALHVNFKDMGWDDWIIAPLEYEAFH

SEQ ID NO: 734 - protein, 28 aa, Ambystoma mexicanum
RRHPLYVDFSDVGWNDWIVAPPGYHAFY

SEQ ID NO: 735 - protein, 30 aa, Ochotona curzoniae
RPIETLVDIFQEYPDEIEYIFKPSCVPLMR

SEQ ID NO: 736 - protein, 30 aa, Ochotona curzoniae; identical to SEQ ID NO: 735

SEQ ID NO: 737 - protein, 28 aa, Rhinolophus ferrumequinum
RRHSLYVDFSDVGWNDWIVAPPGYQAFY

SEQ ID NO: 738 - protein, 28 aa, Rhinolophus ferrumequinum
SRKALHVNFKDMGWDDWIIAPLEYEAFH

SEQ ID NO: 739 - protein, 28 aa, Ovis aries
RKHELYVSFQDLGWQDWIIAPKGYAANY

SEQ ID NO: 740 - protein, 28 aa, Capra hircus
RKHELYVSFQDLGWQDWIIAPKGYAANY

SEQ ID NO: 741 - protein, 28 aa, Mus musculus
KKHELYVSFQDLGWQDWIIAPKGYAANY

SEQ ID NO: 742 - protein, 28 aa, Homo sapiens
KKHELYVSFRDLGWQDWIIAPEGYAAYY

SEQ ID NO: 743 - protein, 28 aa, Danio rerio
RRHSLYVDFSDVGWNDWIVAPPGYHAFY

SEQ ID NO: 744 - protein, 28 aa, Danio rerio
SKKPLHVNFRELGWDDWVIAPLDYEAYH

SEQ ID NO: 745 - protein, 28 aa, Strongylocentrotus purpuratus
RRHELYVDFSDVHWNDWIVAPAGYQAYY

SEQ ID NO: 746 - protein, 28 aa, Drosophila erecta
RRHSLYVDFSDVGWDDWIVAPLGYDAYY

SEQ ID NO: 747 - protein, 28 aa, Sorex araneus
RRHSLYVDFSDVGWNDWIVAPPGYQAFY

SEQ ID NO: 748 - protein, 28 aa, Sorex araneus
SRKALHVNFKDMGWDDWIIAPLEYEAFH

SEQ ID NO: 749 - protein, 28 aa, Saccostrea kegaki
RRKELNVDFKAVGWNDWIFAPPGYNAYY

SEQ ID NO: 750 - protein, 28 aa, Homo sapiens
RKHELYVSFQDLGWQDWIIAPKGYAANY

SEQ ID NO: 751 - protein, 28 aa, Drosophilia grimshawi
RRHSLYVDFQDVGWSDWIVAPPGYDAFY

SEQ ID NO: 752 - protein, 28 aa, Drosophilia mojavensis
RRHSLYVDFQDVGWSDWIVAPPGYDAYY

SEQ ID NO: 753 - protein, 28 aa, Drosophilia virilis
RRHSLYVDFQDVGWSDWIVAPPGYDAYY

SEQ ID NO: 754 - protein, 28 aa, Drosophilia willistoni
RRHSLYVDFADVGWSDWIVAPPGYDAFY

SEQ ID NO: 755 - protein, 28 aa, Drosophilia yakuba
RRHSLYVDFSDVGWDDWIVAPLGYDAYY

SEQ ID NO: 756 - protein, 28 aa, Drosophilia simulans
RRHSLYVDFSDVGWDDWIVAPLGYDAYY

SEQ ID NO: 757 - protein, 30 aa, Sus scrofa; identical to SEQ ID NO: 735

SEQ ID NO: 758 - protein, 28 aa, Xenopus tropicalis
SKKPLHVNFKDMGWDDWIIAPLEYEAYH

SEQ ID NO: 759 - protein, 30 aa, Homo sapiens; identical to SEQ ID NO: 699

SEQ ID NO: 760 - protein, 30 aa, Rattus norvegicus; identical to SEQ ID NO: 735

SEQ ID NO: 761 - protein, 28 aa, Otolemur garnettii
RRHSLYVDFSDVGWNDWIVAPPGYQAFY

SEQ ID NO: 762 - protein, 28 aa, Otolemur garnettii
SRKALHVNFKDMGWDDWIIAPLEYEAFH

SEQ ID NO: 763 - protein, 28 aa, Salmo salar
RRHALYVDFSDVGWNDWIVAPPGYQAYY

SEQ ID NO: 764 - protein, 30 aa, Sus scrofa
RALERLVDIVSVYPSEVEHMFSPSCVSLLR

SEQ ID NO: 765 - protein, 28 aa, Branchiostoma floridae
KRRKLYIRFKDVGWDDWIIAPQGYMAYH

SEQ ID NO: 766 - protein, 28 aa, Branchiostoma floridae
KRRKLYIRFKDVGWDDWIIAPQGYMAYH

SEQ ID NO: 767 - protein, 28 aa, Branchiostoma floridae
MRRSLQVSFHDLGWDDWIIAPTNYDAHY

SEQ ID NO: 768 - protein, 28 aa, Branchiostoma floridae
RRHSLYVDFSDVGWNDWIVAPPGYQAYY

SEQ ID NO: 769 - protein, 28 aa, Branchiostoma floridae
RRLHLYVDFREVGWQDWIIAPPGYHAYY

SEQ ID NO: 770 - protein, 28 aa, Branchiostoma floridae
MRRSLQVSFHDLGWDDWIIAPTNYDAHY

SEQ ID NO: 771 - protein, 28 aa, Stylophora pistillata
QRHPLYVDFSEVGWNDWIVAPPGYQGFY

SEQ ID NO: 772 - protein, 28 aa, Acropora sp. DZ-2008
QRHPLYVDFSEVGWNDWIVAPPGYQGFY

SEQ ID NO: 773 - protein, 30 aa, Pseudocowpox virus
KPRETVVRIGDEYPSLISQRFSPPCVSVMR

SEQ ID NO: 774 - protein, 30 aa, Pseudocowpox virus
KPRETVVRISDEYPSLTSQRFSPPCVSVMR

SEQ ID NO: 775 - protein, 28 aa, Labidochromis caeruleus
HRRRLHVNFKEMGWDDWIIAPLEYDAYH

SEQ ID NO: 776 - protein, 28 aa, Oryctolagus cuniculus
SRKALHVNFKDMGWDDWIIAPLEYEAFH

SEQ ID NO: 777 - protein, 28 aa, Ixodes scapularis
RRFPLRVEFSHVGWNDWIVAPPSYEAYY

SEQ ID NO: 778 - protein, 28 aa, Xenopus laevis
RRHSLYVDFSDVGWNDWIVAPPGYQAFY

SEQ ID NO: 779 - protein, 28 aa, Xenopus laevis
SKKPLHVNFKELGWDDWIIAPLEYEAHH

SEQ ID NO: 780 - protein, 28 aa, Xenopus laevis
RRHPLYVDFSDVGWNDWIVAPPGYHAFY

SEQ ID NO: 781 - protein, 30 aa, Danio rerio; identical to SEQ ID NO: 704

SEQ ID NO: 782 - protein, 28 aa, Salmo salar
RRHALYVDFSDVGWNDWIVAPPGYQAYY

SEQ ID NO: 783 - protein, 28 aa, Gadus morhua
RRHALYVDFSDVGWNDWIVAPPGYQAYY

SEQ ID NO: 784 - protein, 28 aa, Bombyx mori
QRRPLFVDFAEVGWSDWIVAPPGYEAYF

SEQ ID NO: 785 - protein, 28 aa, Mus musculus
KKHELYVSFRDLGWQDWIIAPEGYAAFY

SEQ ID NO: 786 - protein, 28 aa, Salmo salar
RRHALYVDFSDVGWNEWIVAPPGYHAFY

SEQ ID NO: 787 - protein, 30 aa, Bitis arietans
QPRETLVSILEEYPDKISKIFRPSCVAVLR

SEQ ID NO: 788 - protein, 30 aa, Agkistrodon piscivorus piscivorus
QTRETLVSILEEHPHEISHLFKPSCVTVLR

SEQ ID NO: 789 - protein, 30 aa, Crotalus atrox
QTREMLVSILDEYPSEVAHLFRPSCVTVLR

SEQ ID NO: 790 - protein, 30 aa, Agkistrodon piscivorus piscivorus
RPIETMVDIFQEYPDEVEYILKPPCVALMR

SEQ ID NO: 791 - protein, 30 aa, Vipera ammodytes ammodytes
RPVETMVDIFQEYPDEVEYIFKPSCVALMR

SEQ ID NO: 792 - protein, 30 aa, Protobothrops flavoviridis
QTRETLVPILKEYPDEVSHLFKPSCVPVLR

SEQ ID NO: 793 - protein, 30 aa, Protobothrops flavoviridis
RPIETMVDIFQDYPDEVEYILKPPCVALMR

SEQ ID NO: 794 - protein, 30 aa, Vipera ammodytes ammodytes
QARETLVPILQEYPDEISDIFRPSCVAVLR

SEQ ID NO: 795 - protein, 30 aa, Daboia russelli russelli
QTRETLVSILQEHPDEISDIFRPSCVAVLR

SEQ ID NO: 796 - protein, 30 aa, Osmerus mordax
RPRELLVEILQEYPEEVEHIYIPSCVVLTR

SEQ ID NO: 797 - protein, 30 aa, Anoplopoma fimbria
RPMEQLVDVEQEYPGEVEYIYMPACVPLWR

SEQ ID NO: 798 - protein, 28 aa, Dasypus novemcinctus
SRKALHVNFKDMGWDDWIIAPLEYEAFH

SEQ ID NO: 799 - protein, 28 aa, Myotis ricketti
KRHPLYVDFSDVGWNDWIVAPPGYHAFY

SEQ ID NO: 800 - protein, 28 aa, Danio rerio
RRHALYVDFSDVGWNDWIVAPPGYQAYY

SEQ ID NO: 801 - protein, 28 aa, Danio rerio
RRHALYVDFSDVGWNEWIVAPPGYHAFY

SEQ ID NO: 802 - protein, 28 aa, Danio rerio
RRHSLYVDFSDVGWNDWIVAPPGYHAFY

SEQ ID NO: 803 - protein, 28 aa, Dama dama
KRHPLYVDFSDVGWNDWIVAPPGYHAFY

SEQ ID NO: 804 - protein, 28 aa, Danio rerio
NRKQLHVNFKEMGWDDWIIAPLEYEAFH

SEQ ID NO: 805 - protein, 30 aa, Xenopus laevis; identical to SEQ ID NO: 724

SEQ ID NO: 806 - protein, 30 aa, Xenopus laevis; identical to SEQ ID NO: 724

SEQ ID NO: 807 - protein, 28 aa, Oryctolagus cuniculus
KRHPLYVDFSDVGWNDWIVAPPGYHAFY

SEQ ID NO: 808 - protein, 28 aa, Oryctolagus cuniculus
RRHALYVDFSDVGWNDWIVAPPGYQAFY

SEQ ID NO: 809 - protein, 28 aa, Danio rerio
RRHALYVDFSDVGWNEWIVAPPGYHAFY

SEQ ID NO: 810 - protein, 28 aa, Danio rerio
RRHALYVDFSDVGWNDWIVAPPGYQAYY

SEQ ID NO: 811 - protein, 30 aa, Danio rerio
KTRELLVDIIQEYPDEIEHTYIPSCVVLMR

SEQ ID NO: 812 - protein, 30 aa, Danio rerio; identical to SEQ ID NO: 811

SEQ ID NO: 813 - protein, 28 aa, Xenopus laevis
RRHSLYVDFSDVGWNDWIVAPPGYQAFY

SEQ ID NO: 814 - protein, 28 aa, Halocynthia roretzi
QRQDLYVDFSDVNWDDWIVAPHGYHAFY

SEQ ID NO: 815 - protein, 30 aa, Ovis aries; identical to SEQ ID NO: 727

SEQ ID NO: 816 - protein, 30 aa, Rattus norvegicus; identical to SEQ ID NO: 735

SEQ ID NO: 817 - protein, 28 aa, Danio rerio
RRHALYVDFSDVGWNEWIVAPPGYHAFY

SEQ ID NO: 818 - protein, 28 aa, Gallus gallus
SRKPLHVNFKELGWDDWIIAPLDYEAYH

SEQ ID NO: 819 - protein, 28 aa, Branchiostoma floridae
RRHSLYVDFSDVGWNDWIVAPPGYQAYY

SEQ ID NO: 820 - protein, 28 aa, Crassostrea gigas
RRKELNVDFKAVGWNDWIFAPPGYNAYY

SEQ ID NO: 821 - protein, 28 aa, Drosophilia melanogaster
RRHSLYVDFSDVGWDDWIVAPLGYDAYY

SEQ ID NO: 822 - protein, 28 aa, Homo sapiens
KRHPLYVDFSDVGWNDWIVAPPGYHAFY

SEQ ID NO: 823 - protein, 28 aa, Homo sapiens
RRHSLYVDFSDVGWNDWIVAPPGYQAFY

SEQ ID NO: 824 - protein, 30 aa, Bos Taurus; identical to SEQ ID NO: 727

SEQ ID NO: 825 - protein, 30 aa, Bos Taurus; identical to SEQ ID NO: 727

SEQ ID NO: 826 - protein, 30 aa, Bos Taurus; identical to SEQ ID NO: 699

SEQ ID NO: 827 - protein, 30 aa, Bos Taurus; identical to SEQ ID NO: 699

SEQ ID NO: 828 - protein, 30 aa, Bos Taurus; identical to SEQ ID NO: 699

SEQ ID NO: 829 - protein, 30 aa, Bos Taurus; identical to SEQ ID NO: 699

SEQ ID NO: 830 - protein, 30 aa, Bos Taurus; identical to SEQ ID NO: 699

SEQ ID NO: 831 - protein, 30 aa, Bos Taurus; identical to SEQ ID NO: 699

SEQ ID NO: 832 - protein, 30 aa, Bos Taurus; identical to SEQ ID NO: 699

SEQ ID NO: 833 - protein, 30 aa, Bos Taurus; identical to SEQ ID NO: 699

SEQ ID NO: 834 - protein, 30 aa, Bos Taurus; identical to SEQ ID NO: 699

SEQ ID NO: 835 - protein, 30 aa, Bos Taurus; identical to SEQ ID NO: 699

SEQ ID NO: 836 - protein, 30 aa, Rattus norvegicus; identical to SEQ ID NO: 735

SEQ ID NO: 837 - protein, 30 aa, Rattus norvegicus; identical to SEQ ID NO: 735

SEQ ID NO: 838 - protein, 30 aa, Rattus norvegicus; identical to SEQ ID NO: 735

SEQ ID NO: 839 - protein, 30 aa, Rattus norvegicus; identical to SEQ ID NO: 735

SEQ ID NO: 840 - protein, 28 aa, Homo sapiens
KKHELYVSFRDLGWQDWIIAPEGYAAYY

SEQ ID NO: 841 - protein, 28 aa, Mus musculus
KKHELYVSFQDLGWQDWIIAPKGYAANY

SEQ ID NO: 842 - protein, 28 aa, Mus musculus
KRHPLYVDFSDVGWNDWIVAPPGYHAFY

SEQ ID NO: 843 - protein, 28 aa, Mus musculus
RRHSLYVDFSDVGWNDWIVAPPGYQAFY

SEQ ID NO: 844 - protein, 28 aa, Homo sapiens
KKHELYVSFRDLGWQDWIIAPEGYAAFY

SEQ ID NO: 845 - protein, 28 aa, Homo sapiens
RKHELYVSFQDLGWQDWIIAPKGYAANY

SEQ ID NO: 846 - protein, 28 aa, Mus musculus
KKHELYVSFRDLGWQDWIIAPEGYAAYY

SEQ ID NO: 847 - protein, 28 aa, Xenopus laevis
RRHPLYVDFSDVGWNDWIVAPPGYHAFY

SEQ ID NO: 848 - protein, 30 aa, Cavia porcellus
RPIEMLVDIFQEYPDEIEYIFKPSCVPLMR

SEQ ID NO: 849 - protein, 28 aa, Xenopus laevis
RRHPLYVDFSDVGWNDWIVAPPGYHAFY

SEQ ID NO: 850 - protein, 28 aa, Xenopus laevis
RRHSLYVDFSDVGWNDWIVAPPGYQAFY

SEQ ID NO: 851 - protein, 28 aa, Danio rerio
KPRRLYIDFKDVGWQDWIIAPQGYLANY

SEQ ID NO: 852 - protein, 28 aa, Homo sapiens
SRKALHVNFKDMGWDDWIIAPLEYEAFH

SEQ ID NO: 853 - protein, 28 aa, Mus musculus
SRKALHVNFKDMGWDDWIIAPLEYEAFH

SEQ ID NO: 854 - protein, 28 aa, Mus musculus
SRKPLHVNFKELGWDDWIIAPLEYEAYH

SEQ ID NO: 855 - protein, 28 aa, Mus musculus
SRKSLHVDFKELGWDDWIIAPLDYEAYH

SEQ ID NO: 856 - protein, 28 aa, Mus musculus
SRKSLHVDFKELGWDDWIIAPLDYEAYH

SEQ ID NO: 857 - protein, 28 aa, Strongylocentrotus purpuratus
KRKNLFVNFEDLDWQEWIIAPLGYVAFY

SEQ ID NO: 858 - protein, 28 aa, Strongylocentrotus purpuratus
QRHRLFVSFRDVGWENWIIAPMGYQAYY

SEQ ID NO: 859 - protein, 28 aa, Rattus norvegicus
KRHPLYVDFSDVGWNDWIVAPPGYHAFY

SEQ ID NO: 860 - protein, 28 aa, Mus musculus
KKHELYVSFRDLGWQDWIIAPEGYAAFY

SEQ ID NO: 861 - protein, 30 aa, Sus scrofa; identical to SEQ ID NO: 735

SEQ ID NO: 862 - protein, 30 aa, Homo sapiens
RALERLVDVVSEYPSEVEHMFSPSCVSLLR

SEQ ID NO: 863 - protein, 30 aa, Homo sapiens; identical to SEQ ID NO: 862

SEQ ID NO: 864 - protein, 30 aa, Homo sapiens; identical to SEQ ID NO: 862

SEQ ID NO: 865 - protein, 30 aa, Mus musculus
RPMEKLVYILDEYPDEVSHIFSPSCVLLSR

SEQ ID NO: 866 - protein, 30 aa, Ovis aries; identical to SEQ ID NO: 727

SEQ ID NO: 867 - protein, 28 aa, Bos taurus
SKKPLHVNFKELGWDDWIIAPLEYEAYH

SEQ ID NO: 868 - protein, 30 aa, Protobothrops flavoviridis; identical to SEQ ID NO: 793

SEQ ID NO: 869 - protein, 30 aa, Protobothrops flavoviridis; identical to SEQ ID NO: 793

SEQ ID NO: 870 - protein, 30 aa, Protobothrops flavoviridis; identical to SEQ ID NO: 793

SEQ ID NO: 871 - protein, 30 aa, Daboia russelli russelli; identical to SEQ ID NO: 795

SEQ ID NO: 872 - protein, 30 aa, Protobothrops flavoviridis; identical to SEQ ID NO: 792

SEQ ID NO: 873 - protein, 30 aa, Vipera ammodytes ammodytes; identical to SEQ ID NO: 794

SEQ ID NO: 874 - protein, 30 aa, Gallus gallus
RTIETLVDIFQEYPDEVEYIFRPSCVPLMR

SEQ ID NO: 875 - protein, 30 aa, Coturnix coturnix japonica; identical to SEQ ID NO: 874

SEQ ID NO: 876 - protein, 30 aa, Coturnix coturnix japonica; identical to SEQ ID NO: 874

SEQ ID NO: 877 - protein, 30 aa, Coturnix coturnix japonica; identical to SEQ ID NO: 874

SEQ ID NO: 878 - protein, 30 aa, Coturnix coturnix japonica; identical to SEQ ID NO: 874

SEQ ID NO: 879 - protein, 30 aa, Macrovipera lebetina
QARETLVSILQEYPDEISDIFRPSCVAVLR

SEQ ID NO: 880 - protein, 30 aa, Bitis gabonica; identical to SEQ ID NO: 791

SEQ ID NO: 881 - protein, 30 aa, Viper aspis aspis; identical to SEQ ID NO: 879

SEQ ID NO: 882 - protein, 28 aa, Danio rerio
SKKALHVNFKELGWDDWIIAPLDYEAYH

SEQ ID NO: 883 - protein, 28 aa, Gallus gallus
KKHELYVSFRDLGWQDWIIAPEGYAAFY

SEQ ID NO: 884 - protein, 28 aa, Drosophilia simulans
RRHSLYVDFSDVGWDDWIVAPLGYDAYY

SEQ ID NO: 885 - protein, 28 aa, Drosophilia virilis
RRHSLYVDFQDVGWSDWIVAPPGYDAYY

SEQ ID NO: 886 - protein, 30 aa, Mus musculus; identical to SEQ ID NO: 735

SEQ ID NO: 887 - protein, 30 aa, Mus musculus; identical to SEQ ID NO: 735

SEQ ID NO: 888 - protein, 30 aa, Mus musculus; identical to SEQ ID NO: 735

SEQ ID NO: 889 - protein, 30 aa, Mus musculus; identical to SEQ ID NO: 735

SEQ ID NO: 890 - protein, 28 aa, Rattus norvegicus
KKHELYVSFQDLGWQDWIIAPKGYAANY

SEQ ID NO: 891 - protein, 28 aa, Rattus norvegicus
RRHSLYVDFSDVGWNDWIVAPPGYQAFY

SEQ ID NO: 892 - protein, 30 aa, Xenopus tropicalis; identical to SEQ ID NO: 724

SEQ ID NO: 893 - protein, 28 aa, Nematostella vectensis
QRHPLYVDFTDVGWNDWIVAPPGYHAFY

SEQ ID NO: 894 - protein, 30 aa, Danio rerio; identical to SEQ ID NO: 704

SEQ ID NO: 895 - protein, 28 aa, Aedes aegypti
QRRPLYVDFSDVGWSDWIVAPPGYEAYY

SEQ ID NO: 896 - protein, 30 aa, Pantholops hodgsonii; identical to SEQ ID NO: 727

SEQ ID NO: 897 - protein, 30 aa, Danio rerio; identical to SEQ ID NO: 704

SEQ ID NO: 898 - protein, 30 aa, Danio rerio; identical to SEQ ID NO: 704

SEQ ID NO: 899 - protein, 28 aa, Saccoglossus kowalevskii
KKRSLVVSFRELGWQDWIIAPDGYSAFY

SEQ ID NO: 900 - protein, 28 aa, Saccoglossus kowalevskii
KRHELYVDFNDVGWNDWIVAPPGYHAFY

SEQ ID NO: 901 - protein, 28 aa, Drosophila yakuba
RRHSLYVDFSDVGWDDWIVAPLGYDAYY

SEQ ID NO: 902 - protein, 28 aa, Drosophila teissieri
RRHSLYVDFSDVGWDDWIVAPLGYDAYY

SEQ ID NO: 903 - protein, 28 aa, Drosophila orena
RRHSLYVDFSDVGWDDWIVAPLGYDAYY

SEQ ID NO: 904 - protein, 28 aa, Junonia coenia
QRRPLFVDFADVGWSDWIVAPHGYDAYY

SEQ ID NO: 905 - protein, 28 aa, Schistocerca Americana
RRHPLYVDFREVGWDDWIVAPPGYEGWY

SEQ ID NO: 906 - protein, 28 aa, Nematostella vectensis
QRQALHVSFRKLRWQDWVIAPEGYSAFY

SEQ ID NO: 907 - protein, 28 aa, Dama dama
RRHSLYVDFSDVGWNDWIVAPPGYQAFY

SEQ ID NO: 908 - protein, 28 aa, Bos taurus
RRHSLYVDFSDVGWNDWIVAPPGYQAFY

SEQ ID NO: 909 - protein, 28 aa, Eleutherodactylus coqui
RRHSLYVDFSDVGWNDWIVAPPGYQAFY

SEQ ID NO: 910 - protein, 28 aa, Homo sapiens
SRKALHVNFKDMGWDDWIIAPLEYEAFH

SEQ ID NO: 911 - protein, 28 aa, Didelphis albiventris
RRHPLYVDFSDVGWNDWIVAPPGYHAFY

SEQ ID NO: 912 - protein, 28 aa, Platynereis dumerilii
RRHPLYVDFSDVGWDDWIVAPPGYRAYF

SEQ ID NO: 913 - protein, 28 aa, Nematostella vectensis
RRKRMYVDFRLLGWSDWIIAPQGYDAYL

SEQ ID NO: 914 - protein, 30 aa, Protobothrops mucrosquamatus
QTREMLVPILKEYPNEVSHLFKPSCVPVLR

SEQ ID NO: 915 - protein, 30 aa, Anguilla japonica
RPRELLVDIYQEYPEEIEHTYIPSCVVLMR

SEQ ID NO: 916 - protein, 28 aa, Amphiura filiformis
RRHNLYVDFSDVGWNDWIVAPPGYQAYY

SEQ ID NO: 917 - protein, 28 aa, Equus caballus
SRKALHVNFKDMGWDDWIIAPLEYEAFH

SEQ ID NO: 918 - protein, 28 aa, Mus musculus
RRHSLYVDFSDVGWNDWIVAPPGYQAFY

SEQ ID NO: 919 - protein, 28 aa, Mus musculus
KKHELYVSFQDLGWQDWIIAPKGYAANY

SEQ ID NO: 920 - protein, 28 aa, Mus musculus
KRHPLYVDFSDVGWNDWIVAPPGYHAFY

SEQ ID NO: 921 - protein, 28 aa, Mus musculus
KKHELYVSFRDLGWQDWIIAPEGYAAFY

SEQ ID NO: 922 - protein, 28 aa, Mus musculus
KKHELYVSFRDLGWQDWIIAPEGYAAFY

SEQ ID NO: 923 - protein, 28 aa, Mus musculus
KRHPLYVDFSDVGWNDWIVAPPGYHAFY

SEQ ID NO: 924 - protein, 28 aa, Ciona intestinalis
QRHSMWVDFEEMGWSDWVIAPRAFQSYR

SEQ ID NO: 925 - protein, 28 aa, Homo sapiens
RKHELYVSFQDLGWQDWIIAPKGYAANY

SEQ ID NO: 926 - protein, 28 aa, Bos taurus
RRHSLYVDFSDVGWNDWIVAPPGYQAFY

SEQ ID NO: 927 - protein, 28 aa, Macaca fascicularis
KKHELYVSFRDLGWQDWIIAPEGYAAFY

SEQ ID NO: 928 - protein, 30 aa, Tetraodon nigroviridis
RTIEKLVEVVQEYPTEVEYIYSPSCVPLVR

SEQ ID NO: 929 - protein, 28 aa, Tetraodon nigroviridis
RRHSLYVDFSDVGWNDWIVAPPGYQAYY

SEQ ID NO: 930 - protein, 28 aa, Tetraodon nigroviridis
KKHELYVSFRDLGWQDWIIAPEGYAAFY

SEQ ID NO: 931 - protein, 30 aa, Tetraodon nigroviridis
QPMEQLVDVEQEYPGELEYTYMPSCVPLKR

SEQ ID NO: 932 - protein, 28 aa, Tetraodon nigroviridis
SRKALHVNFKELGWDDWIIAPLDYEAHH

SEQ ID NO: 933 - protein, 30 aa, Tetraodon nigroviridis
QPRDVLVDVFQAYPEDTEHIYTPSCVVLKR

SEQ ID NO: 934 - protein, 28 aa, Tetraodon nigroviridis
KARRLYIDFKDVGWQDWIIAPQGYMANY

SEQ ID NO: 935 - protein, 30 aa, Orf virus
KPRPMVFRVHDEYPTLTSQRFNPPCVTLMR

SEQ ID NO: 936 - protein, 28 aa, Homo sapiens
RKHELYVSFQDLGWQDWIIAPKGYAANY

SEQ ID NO: 937 - protein, 28 aa, Homo sapiens
RRHSLYVDFSDVGWNDWIVAPPGYQAFY

SEQ ID NO: 938 - protein, 30 aa, Homo sapiens; identical to SEQ ID NO: 862

SEQ ID NO: 939 - protein, 30 aa, Gallus gallus; identical to SEQ ID NO: 874

SEQ ID NO: 940 - protein, 30 aa, Rattus norvegicus; identical to SEQ ID NO: 735

SEQ ID NO: 941 - protein, 30 aa, Mus musculus; identical to SEQ ID NO: 865

SEQ ID NO: 942 - protein, 28 aa, Xenopus laevis
RRHPLYVDFSDVGWNDWIVAPPGYHAFY

SEQ ID NO: 943 - protein, 28 aa, Amphiura filiformis
QRHSLYVSFREVGWQDWIIAPMGYQAYF

SEQ ID NO: 944 - protein, 30 aa, Homo sapiens; identical to SEQ ID NO: 699

SEQ ID NO: 945 - protein, 28 aa, Bos taurus
RRHSLYVDFSDVGWNDWIVAPPGYQAFY

SEQ ID NO: 946 - protein, 30 aa, Danio rerio; identical to SEQ ID NO: 704

SEQ ID NO: 947 - protein, 28 aa, Danio rerio
KPRRLYIDFKDVGWQDWIIAPQGYLANY

SEQ ID NO: 948 - protein, 28 aa, Nematostella vectensis
RRKRMYVDFRLLGWSDWIIAPQGYDAYL

SEQ ID NO: 949 - protein, 30 aa, Rattus norvegicus
RPMEKLVYIADEHPNEVSHIFSPSCVLLSR

SEQ ID NO: 950 - protein, 30 aa, Rattus norvegicus; identical to SEQ ID NO: 735

SEQ ID NO: 951 - protein, 28 aa, Xenopus tropicalis
KKRRLYIDFKDVGWQNWVIAPRGYMANY

SEQ ID NO: 952 - protein, 28 aa, Xenopus laevis
SKKPLHVNFKDMGWDDWIIAPLEYEAYH

SEQ ID NO: 953 - protein, 28 aa, Rattus norvegicus
RRHSLYVDFSDVGWNDWIVAPPGYQAFY

SEQ ID NO: 954 - protein, 28 aa, Trachemys scripta
KRHPLYVDFNDVGWNDWIVAPPGYGAFY

SEQ ID NO: 955 - protein, 30 aa, Oncohynchus mykiss
RTREMLVDVFQEYPDEIEHTYIPSCVVLMR

SEQ ID NO: 956 - protein, 30 aa, Oncorhynchus mykiss; identical to SEQ ID NO: 955

SEQ ID NO: 957 - protein, 28 aa, Rattus norvegicus
SRKPLHVNFKELGWDDWIIAPLEYEAYH

SEQ ID NO: 958 - protein, 28 aa, Petromyzon marinus
QRQPLYVDFREVGWDDWIVAPPGYNAYF

SEQ ID NO: 959 - protein, 28 aa, Petromyzon marinus
RRHALYVDFREVGWNDWIVAPPGYHAYF

SEQ ID NO: 960 - protein, 28 aa, Petromyzon marinus
ARYPLYVDFSDVGWNDWIVAPPGYNAFF

SEQ ID NO: 961 - protein, 30 aa, Bothrops erythromelas
QPRETLVSILEEYPGEIAHIFRPSCVTALR

SEQ ID NO: 962 - protein, 28 aa, Homo sapiens
SKKPLHVNFKELGWDDWIIAPLEYEAYH

SEQ ID NO: 963 - protein, 28 aa, Xenopus tropicalis
KKHELYVSFKDLGWQDWIIAPEGYAAFY

SEQ ID NO: 964 - protein, 28 aa, Xenopus laevis
RRHSLYVDFSDVGWNDWIVAPPGYQAFY

SEQ ID NO: 965 - protein, 30 aa, Bovine popular stomatitis virus
RPMPTTVRVSDEYPNDTSERYNPQCVTLMR

SEQ ID NO: 966 - protein, 28 aa, Equus caballus
RRHSLYVDFSDVGWNDWIVAPPGYQAFY

SEQ ID NO: 967 - protein, 30 aa, Bovine popular stomatitis virus
QPMKTPVKVSDEYPDNTNDRHSPPCVTLMR

SEQ ID NO: 968 - protein, 30 aa, Homo sapiens; identical to SEQ ID NO: 699

SEQ ID NO: 969 - protein, 28 aa, Gallus gallus
KRHPLYVDFNDVGWNDWIVAPPGYSAFY

SEQ ID NO: 970 - protein, 30 aa, Mus musculus; identical to SEQ ID NO: 735

SEQ ID NO: 971 - protein, 28 aa, Paralichthys olivaceus
KRHALYVDFSDVGWNEWIVAPPGYHAFY

SEQ ID NO: 972 - protein, 28 aa, Homo sapiens
SRKPLHVDFKELGWDDWIIAPLDYEAYH

SEQ ID NO: 973 - protein, 28 aa, Athalia rosae
RRHPLYVDFVDVGWNDWIVAPPGYDAFY

SEQ ID NO: 974 - protein, 30 aa, Orv virus strain D1701
KPRPMVFRVHDEHPELTSQRFNPPCVTLMR

SEQ ID NO: 975 - protein, 28 aa, Tanganicodus irsacae
RRHALYVDFSDVGWNDWIVAPPGYQAYY

SEQ ID NO: 976 - protein, 28 aa, Ophthalmotilapia nasuta
RRHALYVDFSDVGWNDWIVAPPGYQAYY

SEQ ID NO: 977 - protein, 28 aa, Haplotaxodon microlepis
RRHALYVDFSDVGWNDWIVAPPGYQAYY

SEQ ID NO: 978 - protein, 28 aa, Gnathochromis permaxillaris
RRHALYVDFSDVGWNDWIVAPPGYQAYY

SEQ ID NO: 979 - protein, 28 aa, Anopheles gambiae
QRKPLYVDFSDVGWNDWIVAPPGYEAYY

SEQ ID NO: 980 - protein, 28 aa, Danio rerio
KKHELYVSFRDLGWQDWIIAPEGYAAFY

SEQ ID NO: 981 - protein, 28 aa, Homo sapiens
SRKPLHVDFKELGWDDWIIAPLDYEAYH

SEQ ID NO: 982 - protein, 28 aa, Tetraodon nigroviridis
KRHALYVDFSDVGWNEWIVAPPGYHAFY

SEQ ID NO: 983 - protein, 28 aa, Takifugu rubripes
KRHALYVDFSDVGWNEWIVAPPGYHAFY

SEQ ID NO: 984 - protein, 28 aa, Rattus norvegicus
RRHSLYVDFSDVGWNDWIVAPPGYQAFY

SEQ ID NO: 985 - protein, 30 aa, Oryctolagus cuniculus
QPIETLVDIFQEYPDEIEYIFKPSCVPLVR

SEQ ID NO: 986 - protein, 28 aa, Parasteatoda tepidariorum
RRHALYVDFSDVGWNDWIIAPPGYNAYF

SEQ ID NO: 987 - protein, 28 aa, Ilyanassa obsolete
RRHALYVDFQEVGWEDWIVAPDGYNAYF

SEQ ID NO: 988 - protein, 28 aa, Mus musculus
KKHELYVSFQDLGWQDWIIAPKGYAANY

SEQ ID NO: 989 - protein, 28 aa, Mus musculus
SRKALHVNFKDMGWDDWIIAPLEYEAFH

SEQ ID NO: 990 - protein, 28 aa, Mus musculus
KKHELYVSFRDLGWQDWIIAPEGYAAFY

SEQ ID NO: 991 - protein, 30 aa, Mustela vison; identical to SEQ ID NO: 735

SEQ ID NO: 992 - protein, 30 aa, Ovis aries
RPVERLVDIVSEYPSEVEHMFSPSCVSLMR

SEQ ID NO: 993 - protein, 28 aa, Stichopus japonicas
SKHSLYVDFAIVGWDSWILAPEGYQAYY

SEQ ID NO: 994 - protein, 28 aa, Boulengerochromis microlepis
RRHALYVDFSDVGWNDWIVAPPGYQAYY

SEQ ID NO: 995 - protein, 28 aa, Talapia rendalli
RRHALYVDFSDVGWNDWIVAPPGYQAYY

SEQ ID NO: 996 - protein, 28 aa, Tropheus duboisi
RRHALYVDFSDVGWNDWIVAPPGYQAYY

SEQ ID NO: 997 - protein, 28 aa, Steatocranus casuarius
RRHALYVDFSDVGWNDWIVAPPGYQAYY

SEQ ID NO: 998 - protein, 28 aa, Oreochromis niloticus
RRHALYVDFSDVGWNDWIVAPPGYQAYY

SEQ ID NO: 999 - protein, 28 aa, Labidochromis caeruleus
RRHALYVDFSDVGWNDWIVAPPGYQAYY

SEQ ID NO: 1000 - protein, 28 aa, Julidochromis transcriptus
RRHALYVDFSDVGWNDWIVAPPGYQAYY

SEQ ID NO: 1001 - protein, 28 aa, Pundamilia nyererei
RRHALYVDFSDVGWNDWIVAPPGYQAYY

SEQ ID NO: 1002 - protein, 28 aa, Haplochromis burtoni
RRHALYVDFSDVGWNDWIVAPPGYQAYY

SEQ ID NO: 1003 - protein, 28 aa, Cyprichromis leptosome
RRHALYVDFSDVGWNDWIVAPPGYQAYY

SEQ ID NO: 1004 - protein, 28 aa, Ctenochromis horei
RRHALYVDFSDVGWNDWIVAPPGYQAYY

SEQ ID NO: 1005 - protein, 28 aa, Astatoreochromis alluaudi
RRHALYVDFSDVGWNDWIVAPPGYQAYY

SEQ ID NO: 1006 - protein, 28 aa, Suncus murinus
RRHSLYVDFSDVGWNDWIVAPPGYQAFY

SEQ ID NO: 1007 - protein, 28 aa, Patella vulgata
KRHVLYVDFGDVGWNDWIVAPPGYNAYF

SEQ ID NO: 1008 - protein, 28 aa, Acropora millepora
QRHPLYVDFSEVGWNDWIVAPPGYQGFY

SEQ ID NO: 1009 - protein, 28 aa, Hemicentrotus pulcherrimus
KRKNLFVNFEDLDWQEWIIAPLGYVAFY

SEQ ID NO: 1010 - protein, 30 aa, Equus caballus; identical to SEQ ID NO: 735

SEQ ID NO: 1011 - protein, 30 aa, Sus scrofa; identical to SEQ ID NO: 735

SEQ ID NO: 1012 - protein, 30 aa, Sus scrofa; identical to SEQ ID NO: 735

SEQ ID NO: 1013 - protein, 28 aa, Archaster typicus
RRHPLYVDFTDVGWNSWIVAPAGYQAYY

SEQ ID NO: 1014 - protein, 28 aa, Gallus gallus
KPRRLYISFSDVGWENWIIAPQGYMANY

SEQ ID NO: 1015 - protein, 28 aa, Gallus gallus
KRHPLYVDFNDVGWNDWIVAPPGYSAFY

SEQ ID NO: 1016 - protein, 28 aa, Gallus gallus
RRHALYVDFSDVGWNDWIVAPPGYQAFY

SEQ ID NO: 1017 - protein, 30 aa, Bothrops jararaca
QPRETLVSILEEYPGEISHIFRPSCVTALR

SEQ ID NO: 1018 - protein, 30 aa, Bothrops insularis
QTRETLVSILEEHPDEVSHIFRPSCVTALR

SEQ ID NO: 1019 - protein, 28 aa, Lampetra japonica
RRHALYVDFREVGWNDWIVAPPGYHAYF

SEQ ID NO: 1020 - protein, 28 aa, Lampetra japonica
ARYPLYVDFSDVGWNDWIVAPPGYNAFF

SEQ ID NO: 1021 - protein, 28 aa, Xenopus tropicalis
RRHSLYVDFSDVGWNDWIVAPPGYQAFY

SEQ ID NO: 1022 - protein, 28 aa, Xenopus tropicalis
RRHPLYVDFSDVGWNDWIVAPPGYHAFY

SEQ ID NO: 1023 - protein, 28 aa, Gallus gallus
KKHELYVSFRDLGWQDWIIAPEGYAAYY

SEQ ID NO: 1024 - protein, 28 aa, Xenopus laevis
RRHSLYVDFSDVGWNDWIVAPPGYQAFY

SEQ ID NO: 1025 - protein, 30 aa, Felis catus; identical to SEQ ID NO: 735

SEQ ID NO: 1026 - protein, 30 aa, Macaca fascicularis; identical to SEQ ID NO: 699

SEQ ID NO: 1027 - protein, 28 aa, Schistocerca gregaria
RRHPLYVDFREVGWDDWIVAPPGYEAWY

SEQ ID NO: 1028 - protein, 28 aa, Gallus Gallus
KPRRLYISFSDVGWENWIIAPQGYMANY

SEQ ID NO: 1029 - protein, 30 aa, Mesocricetus auratus; identical to SEQ ID NO: 699

SEQ ID NO: 1030 - protein, 30 aa, Macaca mulatta; identical to SEQ ID NO: 699

SEQ ID NO: 1031 - protein, 28 aa, Chlorocebus aethiops
SRKPLHVDFKELGWDDWIIAPLDYEAYH

SEQ ID NO: 1032 - protein, 28 aa, Macaca fascicularis
SRKPLHVDFKELGWDDWIIAPLDYEAYH

SEQ ID NO: 1033 - protein, 28 aa, Xenopus laevis
SKKPLLVNFKELGWDDWIIAPLDYEAYH

SEQ ID NO: 1034 - protein, 30 aa, Mesocricetus auratus; identical to SEQ ID NO: 699

SEQ ID NO: 1035 - protein, 30 aa, Callithrix jacchus; identical to SEQ ID NO: 699

SEQ ID NO: 1036 - protein, 30 aa, Equus caballus; identical to SEQ ID NO: 735

SEQ ID NO: 1037 - protein, 28 aa, Gallus gallus
KKHELYVSFRDLGWQDWIIAPEGYAAYY

SEQ ID NO: 1038 - protein, 30 aa, Canis familiaris; identical to SEQ ID NO: 735

SEQ ID NO: 1039 - protein, 30 aa, Canis familiaris; identical to SEQ ID NO: 735

SEQ ID NO: 1040 - protein, 30 aa, Canis familiaris; identical to SEQ ID NO: 735

SEQ ID NO: 1041 - protein, 30 aa, Ovis aries; identical to SEQ ID NO: 727

SEQ ID NO: 1042 - protein, 28 aa, Canis familiaris
RRHSLYVDFSDVGWNDWIVAPPGYQAFY

SEQ ID NO: 1043 - protein, 28 aa, Danio rerio
KKHELYVSFRDLGWQDWIIAPEGYAAYY

SEQ ID NO: 1044 - protein, 30 aa, Spalax ehrenbergi; identical to SEQ ID NO: 699

SEQ ID NO: 1045 - protein, 28 aa, Branchiostoma belcheri
RRHSLYVDFSDVGWNDWIVAPPGYQAYY

SEQ ID NO: 1046 - protein, 28 aa, Ptychodera flava
RRRSLYVDFSDVGWNDWIVAPPGYNAFY

SEQ ID NO: 1047 - protein, 28 aa, Danio rerio
SRKPLHVNFKELGWDDWIIAPLDYEAYH

SEQ ID NO: 1048 - protein, 28 aa, Gallus gallus
SRKALHVNFKDMGWDDWIIAPLEYEAYH

SEQ ID NO: 1049 - protein, 28 aa, Xenopus laevis
SKKPLHVNFKELGWDDWIIAPLEYEAHH

SEQ ID NO: 1050 - protein, 30 aa, Bos taurus
RPVERLVDIVSEYPSEMEHLFSPSCVSLMR

SEQ ID NO: 1051 - protein, 28 aa, Lytechinus variegatus
RRHPLYVDFSDVHWNDWIVAPAGYQAYY

SEQ ID NO: 1052 - protein, 28 aa, Strongylocentrotus purpuratus
RRHELYVDFSDVHWNDWIVAPAGYQAYY

SEQ ID NO: 1053 - protein, 28 aa, Tripneustes gratilla
RRHPLYVDFSDVHWNDWIVAPAGYQAYY

SEQ ID NO: 1054 - protein, 28 aa, Xenopus laevis
KKHELYVSFKDLGWQDWIIAPEGYAAFY

SEQ ID NO: 1055 - protein, 28 aa, Xenopus laevis
KKRRLYIDFKDVGWQNWVIAPRGYMANY

SEQ ID NO: 1056 - protein, 30 aa, Orf virus; identical to SEQ ID NO: 974

SEQ ID NO: 1057 - protein, 6 aa, Gymnema sylvestre
VKKDEL

SEQ ID NO: 1058 - protein, 6 aa, Acrocinus longimanus
IKNGNG

SEQ ID NO: 1059 - protein, 6 aa, Acrocinus longimanus
IANRNG

SEQ ID NO: 1060 - protein, 6 aa, Acrocinus longimanus
IKNGNG

SEQ ID NO: 1061 - protein, 6 aa, Pimpla hypochondriaca
GFPGRR

SEQ ID NO: 1062 - protein, 6 aa, Pimpla hypochondriaca
SSMGAS

SEQ ID NO: 1063 - protein, 6 aa, Lysiphlebus testaceipes
SPPGFF

SEQ ID NO: 1064 - protein, 6 aa, Bemisia tabaci
ISNWTK

SEQ ID NO: 1065 - protein, 6 aa, Bemisia tabaci
LTKGAS

SEQ ID NO: 1066 - protein, 6 aa, Bemisia tabaci
LSDGAA

SEQ ID NO: 1067 - protein, 6 aa, Bemisia tabaci
LPDGAP

SEQ ID NO: 1068 - protein, 6 aa, Bradysia hygida
IPDGGR

SEQ ID NO: 1069 - protein, 3 aa, Solanum lycopersicum
NEP

SEQ ID NO: 1070 - protein, 3 aa, Solanum lycopersicum
HKP

SEQ ID NO: 1071 - protein, 3 aa, Solanum tuberosum
NKP

SEQ ID NO: 1072 - protein, 3 aa, Solanum tuberosum
NDY

SEQ ID NO: 1073 - protein, 3 aa, Solanum tuberosum
NDY

SEQ ID NO: 1074 - protein, 3 aa, Solanum tuberosum
NDY

SEQ ID NO: 1075 - protein, 3 aa, Solanum tuberosum
NDY

SEQ ID NO: 1076 - protein, 3 aa, Solanum tuberosum
NDY

SEQ ID NO: 1077 - protein, 3 aa, Solanum tuberosum
NDY

SEQ ID NO: 1078 - protein, 3 aa, Solanum tuberosum
NDY

SEQ ID NO: 1079 - protein, 3 aa, Solanum brevidens
NYY

SEQ ID NO: 1080 - protein, 3 aa, Solanum tuberosum
NKP

SEQ ID NO: 1081 - protein, 3 aa, Hyoscyamus niger
FKY

SEQ ID NO: 1082 - protein, 6 aa, Musca domestica
LANGSK

SEQ ID NO: 1083 - protein, 6 aa, Aedes aegypti
AANGEY

SEQ ID NO: 1084 - protein, 6 aa, Aedes aegypti
AANGEY

SEQ ID NO: 1085 - protein, 6 aa, Anopheles gambiae
AKNNEY

SEQ ID NO: 1086 - protein, 6 aa, Mesembryanthemum crystallinum
IKNGKG

SEQ ID NO: 1087 - protein, 6 aa, Mirabilis jalapa
IGNGGR

SEQ ID NO: 1088 - protein, 6 aa, Mirabilis jalapa
IGNGGR

SEQ ID NO: 1089 - protein, 6 aa, Phytolacca Americana
IKNGGR

SEQ ID NO: 1090 - protein, 6 aa, Phytolacca Americana
IKNGGR

SEQ ID NO: 1091 - protein, 6 aa, Phytolacca Americana
IKNGGR

SEQ ID NO: 1092 - protein, 6 aa, Petunia hybrid
PTWDSV

SEQ ID NO: 1093 - protein, 6 aa, Petunia hybrid
PTWEGI

SEQ ID NO: 1094 - protein, 3 aa, Pisum sativum
NGV

SEQ ID NO: 1095 - protein, 3 aa, Pisum sativum
NGV

SEQ ID NO: 1096 - protein, 3 aa, Pisum sativum
NGV

SEQ ID NO: 1097 - protein, 3 aa, Pisum sativum
NGV

SEQ ID NO: 1098 - protein, 3 aa, Pisum sativum
NGV

SEQ ID NO: 1099 - protein, 3 aa, Pisum sativum
NGV

SEQ ID NO: 1100 - protein, 3 aa, Glycine soja
NGA

SEQ ID NO: 1101 - protein, 3 aa, Phaseolus angularis
NGA

SEQ ID NO: 1102 - protein, 3 aa, Phaseolus angularis
NGA

SEQ ID NO: 1103 - protein, 3 aa, Glycine max
NGA

SEQ ID NO: 1104 - protein, 6 aa, Medicago truncatula
PTAGTA

SEQ ID NO: 1105 - protein, 6 aa, Medicago truncatula
ARVGMR

SEQ ID NO: 1106 - protein, 6 aa, Medicago truncatula
PFAGRV

SEQ ID NO: 1107 - protein, 3 aa, Vicia hirsute
NGV

SEQ ID NO: 1108 - protein, 3 aa, Trigonella foenum-graecum
SGI

SEQ ID NO: 1109 - protein, 3 aa, Onobrychis viciifolia
DGV

SEQ ID NO: 1110 - protein, 5 aa, Mundulea sericea
NGRDW

SEQ ID NO: 1111 - protein, 3 aa, Melilotus alba
SGI

SEQ ID NO: 1112 - protein, 5 aa, Philenoptera violacea
NGRDV

SEQ ID NO: 1113 - protein, 3 aa, Canavalia brasiliensis
SGG

SEQ ID NO: 1114 - protein, 3 aa, Bituminaria bituminosa
SGA

SEQ ID NO: 1115 - protein, 3 aa, Bituminaria bituminosa
SGA

SEQ ID NO: 1116 - protein, 3 aa, Bituminaria bituminosa
SGV

SEQ ID NO: 1117 - protein, 3 aa, Phaseolus vulgaris
SGV

SEQ ID NO: 1118 - protein, 3 aa, Glycine max
NGA

SEQ ID NO: 1119 - protein, 3 aa, Medicago truncatula
SGA

SEQ ID NO: 1120 - protein, 2 aa, Mesobuthus martensii
GP

SEQ ID NO: 1121 - protein, 2 aa, Mesobuthus martensii
GP

SEQ ID NO: 1122 - protein, 2 aa, Mesobuthus tamulus
GP

SEQ ID NO: 1123 - protein, 2 aa, Mesobuthus eupeus
MP

SEQ ID NO: 1124 - protein, 2 aa, Buthus sindicus
KP

SEQ ID NO: 1125 - protein, 2 aa, Leiurus quinquestratus hebraeus
GP

SEQ ID NO: 1126 - protein, 2 aa, Mesobuthus eupeus
MP

SEQ ID NO: 1127 - protein, 2 aa, Mesobuthus tamulus
PP

SEQ ID NO: 1128 - protein, 2 aa, Mesobuthus eupeus
MP

SEQ ID NO: 1129 - protein, 2 aa, Mesobuthus eupeus
MP

SEQ ID NO: 1130 - protein, 2 aa, Leiurus quinquestratus hebraeus
SP

SEQ ID NO: 1131 - protein, 2 aa, Buthus sindicus
GP

SEQ ID NO: 1132 - protein, 2 aa, Leiurus quinquestratus quinquestratus
MP

SEQ ID NO: 1133 - protein, 2 aa, Mesobuthus eupeus
GP

SEQ ID NO: 1134 - protein, 2 aa, Mesobuthus eupeus
MP

SEQ ID NO: 1135 - protein, 6 aa, Pandinus imperator
LPHLKR

SEQ ID NO: 1136 - protein, 6 aa, Opistophthalmus carinatus
LPHLKR

SEQ ID NO: 1137 - protein, 6 aa, Opistophthalmus carinatus
LPHLKR

SEQ ID NO: 1138 - protein, 6 aa, Mesobuthus martensii
NRLNKK

SEQ ID NO: 1139 - protein, 6 aa, Scorpio maurus palmatus
LPHLKL

SEQ ID NO: 1140 - protein, 5 aa, Centruroides noxius
VDKSR

SEQ ID NO: 1141 - protein, 5 aa, Centruroides elegans
VDKSR

SEQ ID NO: 1142 - protein, 5 aa, Centruroides gracilis
VDKSR

SEQ ID NO: 1143 - protein, 5 aa, Centruroides sculpturatus
VDKSR

SEQ ID NO: 1144 - protein, 5 aa, Centruroides limpidus limpidus
VDKSR

SEQ ID NO: 1145 - protein, 5 aa, Centruroides exilicauda
VDKSR

SEQ ID NO: 1146 - protein, 5 aa, Centruroides noxius
VNKSR

SEQ ID NO: 1147 - protein, 5 aa, Centruroides elegans
VDKSR

SEQ ID NO: 1148 - protein, 5 aa, Centruroides sculpturatus
VDKSR

SEQ ID NO: 1149 - protein, 5 aa, Centruroides gracilis
VDKSR

SEQ ID NO: 1150 - protein, 5 aa, Centruroides limpidus limpidus
VDKSK

SEQ ID NO: 1151 - protein, 5 aa, Centruroides noxius
VDKSK

SEQ ID NO: 1152 - protein, 5 aa, Centruroides exilicauda
VDKSK

SEQ ID NO: 1153 - protein, 5 aa, Centruroides exilicauda
VDKSK

SEQ ID NO: 1154 - protein, 5 aa, Centruroides exilicauda
VDKSQ

SEQ ID NO: 1155 - protein, 5 aa, Centruroides limpidus limpidus
VDKSK

SEQ ID NO: 1156 - protein, 5 aa, Centruroides limpidus limpidus
VDKSK

SEQ ID NO: 1157 - protein, 5 aa, Centruroides elegans
VDKSK

SEQ ID NO: 1158 - protein, 5 aa, Centruroides sculpturatus
VDKSR

SEQ ID NO: 1159 - protein, 5 aa, Centruroides sculpturatus
VDKSR

SEQ ID NO: 1160 - protein, 5 aa, Centruroides sculpturatus
VDKSQ

SEQ ID NO: 1161 - protein, 5 aa, Centruroides sculpturatus
VEKSK

SEQ ID NO: 1162 - protein, 5 aa, Centruroides sculpturatus
VDKSK

SEQ ID NO: 1163 - protein, 5 aa, Centruroides sculpturatus
VDKSR

SEQ ID NO: 1164 - protein, 5 aa, Centruroides gracilis
VDKSR

SEQ ID NO: 1165 - protein, 6 aa, Momordica charantia
PRIWME

SEQ ID NO: 1166 - protein, 6 aa, Momordica charantia
PLIWME

SEQ ID NO: 1167 - protein, 6 aa, Lagenaria siceraria
PRIYME

SEQ ID NO: 1168 - protein, 6 aa, Citrullus lanatus
PRIYME

SEQ ID NO: 1169 - protein, 6 aa, Cucurbita maxima
PRILME

SEQ ID NO: 1170 - protein, 6 aa, Luffa cylindrical
PRILME

SEQ ID NO: 1171 - protein, 6 aa, Momordica charantia
PRILKQ

SEQ ID NO: 1172 - protein, 6 aa, Momordica cochinchinensis
PKILQR

SEQ ID NO: 1173 - protein, 6 aa, Momordica repens
PRILME

SEQ ID NO: 1174 - protein, 6 aa, Momordica repens
PRILMP

SEQ ID NO: 1175 - protein, 6 aa, Trichosanthes kirilowii
PKILMK

SEQ ID NO: 1176 - protein, 6 aa, Cucumis sativus
PRILMR

SEQ ID NO: 1177 - protein, 6 aa, Bryonia dioica
PRILMR

SEQ ID NO: 1178 - protein, 6 aa, Ecballium elaterium
PRILME

SEQ ID NO: 1179 - protein, 6 aa, Luffa cylindrical
PRIWME

SEQ ID NO: 1180 - protein, 6 aa, Momordocia charantia
PKILKK

SEQ ID NO: 1181 - protein, 6 aa, Momordocia cochinchinensis
PKILMR

SEQ ID NO: 1182 - protein, 6 aa, Sechium edule
PKILMK

SEQ ID NO: 1183 - protein, 6 aa, Cucumis melo
PKILME

SEQ ID NO: 1184 - protein, 6 aa, Cucurbita pepo
PRILME

SEQ ID NO: 1185 - protein, 6 aa, Cyclanthera pedata
PRILME

SEQ ID NO: 1186 - protein, 6 aa, Luffa cylindrical
PRILKQ

SEQ ID NO: 1187 - protein, 6 aa, Momordica charantia
PRILKK

SEQ ID NO: 1188 - protein, 6 aa, Momordica cochinchinensis
PRILMK

SEQ ID NO: 1189 - protein, 6 aa, Cucurbita maxima
PRILMK

SEQ ID NO: 1190 - protein, 6 aa, Cucumis sativus
PRILME

SEQ ID NO: 1191 - protein, 6 aa, Luffa cylindrical
PRILMP

SEQ ID NO: 1192 - protein, 6 aa, Cyclanthera pedata
PRILME

SEQ ID NO: 1193 - protein, 6 aa, Luffa cylindrical
PRILMP

SEQ ID NO: 1194 - protein, 6 aa, Sechium edule
PRILMK

SEQ ID NO: 1195 - protein, 6 aa, Cyclanthera pedata
PRILMK

SEQ ID NO: 1196 - protein, 6 aa, Cyclanthera pedata
PRILMK

SEQ ID NO: 1197 - protein, 6 aa, Momordica charantia
PRIWME

SEQ ID NO: 1198 - protein, 6 aa, Cucumis melo
PRILMK

SEQ ID NO: 1199 - protein, 6 aa, Cucumis melo
PKILMK

SEQ ID NO: 1200 - protein, 6 aa, Cucumis melo
PKILMK

SEQ ID NO: 1201 - protein, 6 aa, Mirabilis jalapa
AKTDQI

SEQ ID NO: 1202 - protein, 6 aa, Spinacia oleracea
SPSGAI

SEQ ID NO: 1203 - protein, 6 aa, Spinacia oleracea
SPSGAI

SEQ ID NO: 1204 - protein, 6 aa, Spinacia oleracea
SPSGAI

SEQ ID NO: 1205 - protein, 5 aa, Ancylometes
TKQAD

SEQ ID NO: 1206 - protein, 6 aa, Atrax robustus
IPSGQP

SEQ ID NO: 1207 - protein, 6 aa, Atrax robustus
TPTGQP

SEQ ID NO: 1208 - protein, 6 aa, Atrax robustus
IPSGQP

SEQ ID NO: 1209 - protein, 6 aa, Atrax robustus
IPSGQP

SEQ ID NO: 1210 - protein, 6 aa, Atrax robustus
IPSGQP

SEQ ID NO: 1211 - protein, 6 aa, Lycosa kazakhstanicus
ITWRNS

SEQ ID NO: 1212 - protein, 6 aa, Lycosa kazakhstanicus
ITWRNS

SEQ ID NO: 1213 - protein, 6 aa, Lycosa kazakhstanicus
ITWRNS

SEQ ID NO: 1214 - protein, 6 aa, Lycosa kazakhstanicus
ITWRNS

SEQ ID NO: 1215 - protein, 6 aa, Lycosa kazakhstanicus
ITWRNS

SEQ ID NO: 1216 - protein, 6 aa, Lycosa kazakhstanicus
TTWRNS

SEQ ID NO: 1217 - protein, 6 aa, Lycosa kazakhstanicus
ITWRNS

SEQ ID NO: 1218 - protein, 6 aa, Grammostola rosea
QKWLWT

SEQ ID NO: 1219 - protein, 6 aa, Grammostola rosea
QKWMWT

SEQ ID NO: 1220 - protein, 6 aa, Chilobrachys juingzhao
KKMFGG

SEQ ID NO: 1221 - protein, 6 aa, Chilobrachys juingzhao
GGFWWK

SEQ ID NO: 1222 - protein, 6 aa, Chilobrachys juingzhao
RWMFGG

SEQ ID NO: 1223 - protein, 6 aa, Chilobrachys juingzhao
GGLMAG

SEQ ID NO: 1224 - protein, 6 aa, Chilobrachys juingzhao
GGLMAG

SEQ ID NO: 1225 - protein, 6 aa, Chilobrachys juingzhao
IEEGKW

SEQ ID NO: 1226 - protein, 6 aa, Chilobrachys juingzhao
IEEGKW

SEQ ID NO: 1227 - protein, 6 aa, Chilobrachys juingzhao
IEEGKW

SEQ ID NO: 1228 - protein, 6 aa, Chilobrachys juingzhao
FKEGHS

SEQ ID NO: 1229 - protein, 6 aa, Chilobrachys juingzhao
EPSGKP

SEQ ID NO: 1230 - protein, 6 aa, Chilobrachys juingzhao
QKWMWT

SEQ ID NO: 1231 - protein, 6 aa, Chilobrachys juingzhao
QKWMWT

SEQ ID NO: 1232 - protein, 6 aa, Chilobrachys juingzhao
GQFWWK

SEQ ID NO: 1233 - protein, 6 aa, Chilobrachys juingzhao
GQFWWK

SEQ ID NO: 1234 - protein, 6 aa, Chilobrachys juingzhao
GTMWSP

SEQ ID NO: 1235 - protein, 6 aa, Chilobrachys juingzhao
QKFFWT

SEQ ID NO: 1236 - protein, 6 aa, Chilobrachys juingzhao
QKFFWT

SEQ ID NO: 1237 - protein, 6 aa, Chilobrachys juingzhao
GGLMAG

SEQ ID NO: 1238 - protein, 6 aa, Chilobrachys juingzhao
GGLMDG

SEQ ID NO: 1239 - protein, 6 aa, Chilobrachys juingzhao
GGLMDG

SEQ ID NO: 1240 - protein, 6 aa, Chilobrachys juingzhao
GGLMDG

SEQ ID NO: 1241 - protein, 6 aa, Chilobrachys juingzhao
GEFMWK

SEQ ID NO: 1242 - protein, 6 aa, Chilobrachys juingzhao
GEFMWK

SEQ ID NO: 1243 - protein, 6 aa, Chilobrachys juingzhao
GEFMWK

SEQ ID NO: 1244 - protein, 6 aa, Chilobrachys juingzhao
KGFQVK

SEQ ID NO: 1245 - protein, 6 aa, Chilobrachys juingzhao
KGFQVK

SEQ ID NO: 1246 - protein, 6 aa, Chilobrachys juingzhao
KGFQVK

SEQ ID NO: 1247 - protein, 6 aa, Chilobrachys juingzhao
YDIGEL

SEQ ID NO: 1248 - protein, 6 aa, Chilobrachys juingzhao
GGFWWK

SEQ ID NO: 1249 - protein, 6 aa, Chilobrachys juingzhao
GGFWWK

SEQ ID NO: 1250 - protein, 6 aa, Chilobrachys juingzhao
RKMFGG

SEQ ID NO: 1251 - protein, 6 aa, Chilobrachys juingzhao
RKMFGG

SEQ ID NO: 1252 - protein, 6 aa, Chilobrachys juingzhao
RKMFGG

SEQ ID NO: 1253 - protein, 6 aa, Chilobrachys juingzhao
RKMFGG

SEQ ID NO: 1254 - protein, 6 aa, Chilobrachys juingzhao
RKMFGG

SEQ ID NO: 1255 - protein, 6 aa, Chilobrachys juingzhao
RKMFGG

SEQ ID NO: 1256 - protein, 6 aa, Chilobrachys juingzhao
RKMFGG

SEQ ID NO: 1257 - protein, 6 aa, Chilobrachys juingzhao
RKMFGG

SEQ ID NO: 1258 - protein, 6 aa, Chilobrachys juingzhao
GGWMAK

SEQ ID NO: 1259 - protein, 6 aa, Chilobrachys juingzhao
GGWMAK

SEQ ID NO: 1260 - protein, 6 aa, Chilobrachys juingzhao
GGWMAK

SEQ ID NO: 1261 - protein, 6 aa, Chilobrachys juingzhao
GGWMAK

SEQ ID NO: 1262 - protein, 6 aa, Chilobrachys juingzhao
RGYGLP

SEQ ID NO: 1263 - protein, 6 aa, Chilobrachys juingzhao
LGMFSS

SEQ ID NO: 1264 - protein, 6 aa, Chilobrachys juingzhao
LGLFSS

SEQ ID NO: 1265 - protein, 6 aa, Chilobrachys juingzhao
TKFLGG

SEQ ID NO: 1266 - protein, 6 aa, Chilobrachys juingzhao
TKFLGG

SEQ ID NO: 1267 - protein, 6 aa, Chilobrachys juingzhao
TKLLGG

SEQ ID NO: 1268 - protein, 6 aa, Chilobrachys juingzhao
RYLMGG

SEQ ID NO: 1269 - protein, 6 aa, Chilobrachys juingzhao
REWLGG

SEQ ID NO: 1270 - protein, 6 aa, Chilobrachys juingzhao
RALYGG

SEQ ID NO: 1271 - protein, 6 aa, Chilobrachys juingzhao
RALYGG

SEQ ID NO: 1272 - protein, 6 aa, Chilobrachys juingzhao
RWLFGG

SEQ ID NO: 1273 - protein, 6 aa, Chilobrachys juingzhao
RWLFGG

SEQ ID NO: 1274 - protein, 6 aa, Chilobrachys juingzhao
RWLFGG

SEQ ID NO: 1275 - protein, 6 aa, Chilobrachys juingzhao
RWLFGG

SEQ ID NO: 1276 - protein, 6 aa, Chilobrachys juingzhao
RWLFGG

SEQ ID NO: 1277 - protein, 6 aa, Chilobrachys juingzhao
RWMFGG

SEQ ID NO: 1278 - protein, 6 aa, Chilobrachys juingzhao
RWMFGG

SEQ ID NO: 1279 - protein, 6 aa, Chilobrachys juingzhao
KWYLGD

SEQ ID NO: 1280 - protein, 6 aa, Chilobrachys juingzhao
GEKNDR

SEQ ID NO: 1281 - protein, 6 aa, Chilobrachys juingzhao
GEKNDR

SEQ ID NO: 1282 - protein, 6 aa, Chilobrachys juingzhao
RKMFGG

SEQ ID NO: 1283 - protein, 6 aa, Chilobrachys juingzhao
LGLFWI

SEQ ID NO: 1284 - protein, 6 aa, Chilobrachys juingzhao
IERMQT

SEQ ID NO: 1285 - protein, 6 aa, Chilobrachys juingzhao
IERMQT

SEQ ID NO: 1286 - protein, 6 aa, Chilobrachys juingzhao
IERMQT

SEQ ID NO: 1287 - protein, 6 aa, Chilobrachys juingzhao
WGANVP

SEQ ID NO: 1288 - protein, 6 aa, Chilobrachys juingzhao
WGANVP

SEQ ID NO: 1289 - protein, 6 aa, Chilobrachys juingzhao
GHLHDP

SEQ ID NO: 1290 - protein, 6 aa, Chilobrachys juingzhao
RWFWGA

SEQ ID NO: 1291 - protein, 6 aa, Chilobrachys juingzhao
SRKTWP

SEQ ID NO: 1292 - protein, 6 aa, Calisoga sp
ISARYP

SEQ ID NO: 1293 - protein, 6 aa, Calisoga sp
ISARYP

SEQ ID NO: 1294 - protein, 6 aa, Calisoga sp
ISARYP

SEQ ID NO: 1295 - protein, 6 aa, Ctenus ornatus
TYPGQQ

SEQ ID NO: 1296 - protein, 6 aa, Chilobrachys juingzhao
RKMFGG

SEQ ID NO: 1297 - protein, 6 aa, Chilobrachys juingzhao
QKWMWT

SEQ ID NO: 1298 - protein, 6 aa, Chilobrachys juingzhao
GQFWWK

SEQ ID NO: 1299 - protein, 6 aa, Chilobrachys juingzhao
GGFWWK

SEQ ID NO: 1300 - protein, 6 aa, Chilobrachys juingzhao
QKWMWT

SEQ ID NO: 1301 - protein, 6 aa, Chilobrachys juingzhao
GGLMAG

SEQ ID NO: 1302 - protein, 6 aa, Grammostoal rosea
QKWMWT

SEQ ID NO: 1303 - protein, 6 aa, Grammostoal rosea
LEFWWK

SEQ ID NO: 1304 - protein, 6 aa, Agelena orientalis
AEKGIK

SEQ ID NO: 1305 - protein, 6 aa, Agelena orientalis
VGENGH

SEQ ID NO: 1306 - protein, 6 aa, Agelena orientalis
VGENGR

SEQ ID NO: 1307 - protein, 6 aa, Agelena orientalis
VGENQQ

SEQ ID NO: 1308 - protein, 6 aa, Agelena orientalis
VGENQQ

SEQ ID NO: 1309 - protein, 6 aa, Agelena orientalis
VGENQQ

SEQ ID NO: 1310 - protein, 6 aa, Agelena orientalis
VGESQQ

SEQ ID NO: 1311 - protein, 6 aa, Agelena orientalis
VGESQQ

SEQ ID NO: 1312 - protein, 6 aa, Agelena orientalis
VGESQQ

SEQ ID NO: 1313 - protein, 6 aa, Agelena orientalis
VGENQQ

SEQ ID NO: 1314 - protein, 6 aa, Agelena orientalis
VGDGQR

SEQ ID NO: 1315 - protein, 6 aa, Agelena orientalis
VGENQQ

SEQ ID NO: 1316 - protein, 6 aa, Agelena orientalis
VGDGQR

SEQ ID NO: 1317 - protein, 6 aa, Agelena orientalis
AAKNKR

SEQ ID NO: 1318 - protein, 4 aa, Agelena orientalis
THGS

SEQ ID NO: 1319 - protein, 6 aa, Agelena orientalis
VGENQQ

SEQ ID NO: 1320 - protein, 6 aa, Agelena orientalis
LPRNKF

SEQ ID NO: 1321 - protein, 6 aa, Agelena orientalis
LPRNKF

SEQ ID NO: 1322 - protein, 6 aa, Agelena orientalis
LPRNKF

SEQ ID NO: 1323 - protein, 6 aa, Agelena orientalis
LPRNKF

SEQ ID NO: 1324 - protein, 6 aa, Agelena orientalis
LPHNRF

SEQ ID NO: 1325 - protein, 6 aa, Agelena orientalis
LPHNKF

SEQ ID NO: 1326 - protein, 6 aa, Agelena orientalis
LPHNRF

SEQ ID NO: 1327 - protein, 6 aa, Agelena orientalis
LPHNRF

SEQ ID NO: 1328 - protein, 6 aa, Agelena orientalis
LPHNRF

SEQ ID NO: 1329 - protein, 6 aa, Agelena orientalis
LPHNRF

SEQ ID NO: 1330 - protein, 6 aa, Agelena orientalis
LPHNRF

SEQ ID NO: 1331 - protein, 6 aa, Agelena orientalis
LPHNRF

SEQ ID NO: 1332 - protein, 6 aa, Agelena orientalis
LPHNRF

SEQ ID NO: 1333 - protein, 6 aa, Agelena orientalis
LPHNRF

SEQ ID NO: 1334 - protein, 6 aa, Agelena orientalis
LPRNRF

SEQ ID NO: 1335 - protein, 6 aa, Agelena orientalis
LPHNRF

SEQ ID NO: 1336 - protein, 6 aa, Agelena orientalis
LPHNRF

SEQ ID NO: 1337 - protein, 6 aa, Segestria florentina
MTDGTV

SEQ ID NO: 1338 - protein, 6 aa, Segestria florentina
MADETV

SEQ ID NO: 1339 - protein, 6 aa, Segestria florentina
MVDGTV

SEQ ID NO: 1340 - protein, 6 aa, Segestria florentina
MVDGTV

SEQ ID NO: 1341 - protein, 6 aa, Segestria florentina
MVDGTV

SEQ ID NO: 1342 - protein, 6 aa, Segestria florentina
MTDETV

SEQ ID NO: 1343 - protein, 6 aa, Segestria florentina
MADGTV

SEQ ID NO: 1344 - protein, 6 aa, Segestria florentina
MADGTV

SEQ ID NO: 1345 - protein, 6 aa, Phoneutria nigriventer
RFNGQQ

SEQ ID NO: 1346 - protein, 6 aa, Tachypleus tridentatus
ATYGQK

SEQ ID NO: 1347 - protein, 6 aa, Hadronyche formidabilis
TGADRP

SEQ ID NO: 1348 - protein, 6 aa, Hadronyche versuta
TGADRP

SEQ ID NO: 1349 - protein, 6 aa, Hadronyche versuta
TGADRP

SEQ ID NO: 1350 - protein, 6 aa, Hadronyche versuta
TGADRP

SEQ ID NO: 1351 - protein, 7 aa, Agelenopsis aperta
IAKDYGR

SEQ ID NO: 1352 - protein, 7 aa, Agelenopsis aperta
IAEDYGK

SEQ ID NO: 1353 - protein, 6 aa, Missulena bradleyi
TPSGQP

SEQ ID NO: 1354 - protein, 6 aa, Atrax robustus
IPSGQP

SEQ ID NO: 1355 - protein, 6 aa, Hadronyche infensa
TPTDQP

SEQ ID NO: 1356 - protein, 6 aa, Hadronyche versuta
IPSGQP

SEQ ID NO: 1357 - protein, 6 aa, Hadronyche formidabilis
IRSGQP

SEQ ID NO: 1358 - protein, 6 aa, Hadronyche infensa
IPTGQP

SEQ ID NO: 1359 - protein, 6 aa, Hdronyche versuta
IPSGQP

SEQ ID NO: 1360 - protein, 6 aa, Hadronyche infensa
IRTDQP

SEQ ID NO: 1361 - protein, 6 aa, Hadronyche versuta
IPSGQP

SEQ ID NO: 1362 - protein, 6 aa, Hadronyche versuta
IPSGQP

SEQ ID NO: 1363 - protein, 6 aa, Hadronyche versuta
IPSGQP

SEQ ID NO: 1364 - protein, 6 aa, Hadronyche versuta
IPSGQP

SEQ ID NO: 1365 - protein, 5 aa, Atrax
VLSRV

SEQ ID NO: 1366 - protein, 6 aa, Hadronyche infensa
VVNTLG

SEQ ID NO: 1367 - protein, 6 aa, Hadronyche versuta
LFGNGR

SEQ ID NO: 1368 - protein, 5 aa, Atrax
VLSRV

SEQ ID NO: 1369 - protein, 6 aa, Hadronyche infensa
VLNTLG

SEQ ID NO: 1370 - protein, 6 aa, Cupiennius salei
TLRNHD

SEQ ID NO: 1371 - protein, 6 aa, Phoneutria nigriventer
RSNGQQ

SEQ ID NO: 1372 - protein, 6 aa, Phoneturia reidyi
RFNGQQ

SEQ ID NO: 1373 - protein, 6 aa, Phoneutria keyserlingi
ADAWKS

SEQ ID NO: 1374 - protein, 6 aa, Lycosa kazakhstanicus
ITWRNS

SEQ ID NO: 1375 - protein, 6 aa, Certagyrus marshalli
LGWFKS

SEQ ID NO: 1376 - protein, 6 aa, Grammostola rosea
QKWMWT

SEQ ID NO: 1377 - protein, 6 aa, Heteroscodra maculata
RYLFGG

SEQ ID NO: 1378 - protein, 6 aa, Psalmopoeus cambridgei
RWFMGG

SEQ ID NO: 1379 - protein, 6 aa, Stromatopelma calceatum griseipes
RYLFGG

SEQ ID NO: 1380 - protein, 6 aa, Stromatopelma calceatum
TRMFGA

SEQ ID NO: 1381 - protein, 6 aa, Theraphosa blondi
LGMFES

SEQ ID NO: 1382 - protein, 6 aa, Phoneutria keyserlingi
KYNGEQ

SEQ ID NO: 1383 - protein, 6 aa, Phoneutria keyserlingi
IGHRRS

SEQ ID NO: 1384 - protein, 6 aa, Phoneutria nigriventer
PKILKQ

SEQ ID NO: 1385 - protein, 6 aa, Phoneutria nigriventer
RFNGQQ

SEQ ID NO: 1386 - protein, 6 aa, Phoneutria nigriventer
APRFSL

SEQ ID NO: 1387 - protein, 6 aa, Phoneutria reidyi
APRGLL

SEQ ID NO: 1388 - protein, 5 aa, Phoneutria nigriventer
IPFKP

SEQ ID NO: 1389 - protein, 6 aa, Ceratogyrus marshalli
LGWFKS

SEQ ID NO: 1390 - protein, 6 aa, Heteroscodra maculata
RYFWGE

SEQ ID NO: 1391 - protein, 6 aa, Psalmopoeus cambridgei
RWFLGG

SEQ ID NO: 1392 - protein, 6 aa, Theraphosa blondi
LGMFSS

SEQ ID NO: 1393 - protein, 6 aa, Phoneutria nigriventer
AAVYER

SEQ ID NO: 1394 - protein, 6 aa, Segestria florentina
IESGKS

SEQ ID NO: 1395 - protein, 6 aa, Phoneutria keyserlingi
APRGQL

SEQ ID NO: 1396 - protein, 6 aa, Phoneutria nigriventer
AGLYKK

SEQ ID NO: 1397 - protein, 6 aa, Phoneutria nigriventer
ADAYKS

SEQ ID NO: 1398 - protein, 6 aa, Phoneutria nigriventer
IGHRRS

SEQ ID NO: 1399 - protein, 6 aa, Phoneutria nigriventer
IGRNES

SEQ ID NO: 1400 - protein, 6 aa, Phoneutria reidyi
AGLYKK

SEQ ID NO: 1401 - protein, 6 aa, Phoneutria nigriventer
ADVYKE

SEQ ID NO: 1402 - protein, 6 aa, Ceratogyrus marshalli
RKLLGG

SEQ ID NO: 1403 - protein, 6 aa, Loxosceles intermedia
IKYGDR

SEQ ID NO: 1404 - protein, 6 aa, Paraphysa scrofa
LGFLWK

SEQ ID NO: 1405 - protein, 6 aa, Psalmopeoeus cambridgei
RWYLGG

SEQ ID NO: 1406 - protein, 6 aa, Theraphosa blondi
LGMFSS

SEQ ID NO: 1407 - protein, 6 aa, Hysterocrates gigas
RYMFGG

SEQ ID NO: 1408 - protein, 6 aa, Heteropoda venatoria
GWIMDD

SEQ ID NO: 1409 - protein, 6 aa, Heteropoda venatoria
GWLFHS

SEQ ID NO: 1410 - protein, 6 aa, Allagelena opulenta
LPHNRF

SEQ ID NO: 1411 - protein, 6 aa, Agelena orientalis
LPHNRF

SEQ ID NO: 1412 - protein, 6 aa, Cupiennius salei
IPKHEE

SEQ ID NO: 1413 - protein, 6 aa, Hololena curta
VGEYGR

SEQ ID NO: 1414 - protein, 6 aa, Hololena curta
VGDGQR

SEQ ID NO: 1415 - protein, 6 aa, Hololena curta
VGDGQK

SEQ ID NO: 1416 - protein, 6 aa, Phoneutria nigriventer
AQKGIK

SEQ ID NO: 1417 - protein, 6 aa, Phoneutria reidyi
ADAYKS

SEQ ID NO: 1418 - protein, 6 aa, Cupiennius salei
IPKHHE

SEQ ID NO: 1419 - protein, 6 aa, Pireneitega luctuosa
LGEGEK

SEQ ID NO: 1420 - protein, 6 aa, Pireneitega luctuosa
VGDGQR

SEQ ID NO: 1421 - protein, 6 aa, Pireneitega luctuosa
LNEGDW

SEQ ID NO: 1422 - protein, 6 aa, Pireneitega luctuosa
ATKNQR

SEQ ID NO: 1423 - protein, 6 aa, Hadronyche versuta
AKKRNW

SEQ ID NO: 1424 - protein, 6 aa, Psalmopoeus cambridgei
GILHDN

SEQ ID NO: 1425 - protein, 6 aa, Psalmopoeus cambridgei
LPAGKT

SEQ ID NO: 1426 - protein, 6 aa, Ctenus ornatus
VPVYKE

SEQ ID NO: 1427 - protein, 6 aa, Chilobrachys jingzhao
GGFWWK

SEQ ID NO: 1428 - protein, 6 aa, Chilobrachys jingzhao
GGFWWK

SEQ ID NO: 1429 - protein, 6 aa, Chilobrachys jingzhao
RKMFGG

SEQ ID NO: 1430 - protein, 6 aa, Haplopelma schmidti
LPPGKP

SEQ ID NO: 1431 - protein, 6 aa, Haplopelma schmidti
KGVFDA

SEQ ID NO: 1432 - protein, 6 aa, Haplopelma schmidti
AGYMRE

SEQ ID NO: 1433 - protein, 6 aa, Haplopelma schmidti
LEIFKA

SEQ ID NO: 1434 - protein, 6 aa, Haplopelma schmidti
RWYLGG

SEQ ID NO: 1435 - protein, 6 aa, Haplopelma schmidti
APEGGP

SEQ ID NO: 1436 - protein, 6 aa, Haplopelma hainanum
KGFGKS

SEQ ID NO: 1437 - protein, 6 aa, Haplopelma hainanum
KGFGDS

SEQ ID NO: 1438 - protein, 6 aa, Haplopelma hainanum
LGFGKG

SEQ ID NO: 1439 - protein, 6 aa, Haplopelma hainanum
LGFGKG

SEQ ID NO: 1440 - protein, 6 aa, Grammostola rosea
RYLFGG

SEQ ID NO: 1441 - protein, 6 aa, Grammostola rosea
RYLFGG

SEQ ID NO: 1442 - protein, 6 aa, Heteropoda venatoria
GTIWHY

SEQ ID NO: 1443 - protein, 6 aa, Diguetia canities
GKLFSG

SEQ ID NO: 1444 - protein, 6 aa, Diguetia canities
GTLFSG

SEQ ID NO: 1445 - protein, 7 aa, Heteropoda venatoria
MKYKSGD

SEQ ID NO: 1446 - protein, 6 aa, Hapopelma schmidti
KKYDVE

SEQ ID NO: 1447 - protein, 6 aa, Lasiodora
GTLFSG

SEQ ID NO: 1448 - protein, 4 aa, Macrothele gigas
LGDK

SEQ ID NO: 1449 - protein, 6 aa, Macrothele gigas
GGVDAP

SEQ ID NO: 1450 - protein, 6 aa, Ctenus ornatus
LAEYQK

SEQ ID NO: 1451 - protein, 6 aa, Agelenopsis aperta
KLTFWR

SEQ ID NO: 1452 - protein, 6 aa, Macrothele gigas
VPVYKE

SEQ ID NO: 1453 - protein, 6 aa, Agelenopsis aperta
VPENGH

SEQ ID NO: 1454 - protein, 6 aa, ;PRT1;Macrothele gigas
MGYDIH

SEQ ID NO: 1455 - protein, 6 aa, Agelenopsis aperta
ATKNKR

SEQ ID NO: 1456 - protein, 6 aa, Macrothele gigas
MGYDIE

SEQ ID NO: 1457 - protein, 6 aa, Agelenopsis aperta
VGDGQR

SEQ ID NO: 1458 - protein, 6 aa, Agelenopsis aperta
VGENQQ

SEQ ID NO: 1459 - protein, 6 aa, Agelenopsis aperta
VGENKQ

SEQ ID NO: 1460 - protein, 6 aa, ;PRT1;Macrothele gigas
KLTFWK

SEQ ID NO: 1461 - protein, 6 aa, Agelenopsis aperta
VGESQQ

SEQ ID NO: 1462 - protein, 4 aa, ;PRT1;Macrothele gigas
VDGS

SEQ ID NO: 1463 - protein, 6 aa, ;PRT1;Macrothele gigas
APEGGP

SEQ ID NO: 1464 - protein, 6 aa, ;PRT1;Macrothele gigas
KGLFRQ

SEQ ID NO: 1465 - protein, 6 aa, ;PRT1;Macrothele gigas
GTNGKP

SEQ ID NO: 1466 - protein, 6 aa, Paraphysa scrofa
QKWMWT

SEQ ID NO: 1467 - protein, 6 aa, Psalmopoeus cambridgei
IPKWKG

SEQ ID NO: 1468 - protein, 6 aa, Paraphysa scrofa
QKWMWT

SEQ ID NO: 1469 - protein, 6 aa, Apomastus schlingeri
NSKGTP

SEQ ID NO: 1470 - protein, 6 aa, Brachypelma smithi
VDFQTK

SEQ ID NO: 1471 - protein, 6 aa, Apomastus schlingeri
ARVKEA

SEQ ID NO: 1472 - protein, 6 aa, Thrixopelma pruriens
RYWLGG

SEQ ID NO: 1473 - protein, 6 aa, Thrixopelma pruriens
QKWMWT

SEQ ID NO: 1474 - protein, 6 aa, Macrothele gigas
MGYDIE

SEQ ID NO: 1475 - protein, 6 aa, Macrothele raveni
KLTFWK

SEQ ID NO: 1476 - protein, 6 aa, Heteropoda venatoria
GGLFSG

SEQ ID NO: 1477 - protein, 6 aa, Coremiocnemis valida
SRAGEN

SEQ ID NO: 1478 - protein, 6 aa, Grammostola rosea
GKFMWK

SEQ ID NO: 1479 - protein, 6 aa, Grammostola rosea
QKWMWT

SEQ ID NO: 1480 - protein, 6 aa, Grammostola rosea
LGWFKG

SEQ ID NO: 1481 - protein, 6 aa, Grammostola rosea
VRFWGK

SEQ ID NO: 1482 - protein, 6 aa, Asteropus simplex
GLFGDL

SEQ ID NO: 1483 - protein, 3 aa, Terebra sublata
PEY

SEQ ID NO: 1484 - protein, 6 aa, Hyposoter fugitivus ichnovirus
TPNYAD

SEQ ID NO: 1485 - protein, 6 aa, Hyposoter fugitivus ichnovirus
IPNYAH

SEQ ID NO: 1486 - protein, 6 aa, Hyposoter fugitivus ichnovirus
IPQGSY

SEQ ID NO: 1487 - protein, 6 aa, Hyposoter fugitivus ichnovirus
IPQGSY

SEQ ID NO: 1488 - protein, 6 aa, Hyposoter fugitivus ichnovirus
IPEGSY

SEQ ID NO: 1489 - protein, 6 aa, Campoletis sonorensis ichnovirus
IDNWKY

SEQ ID NO: 1490 - protein, 6 aa, Cotesia congregate bracovirus
LKLKSN

SEQ ID NO: 1491 - protein, 6 aa, Cotesia congregate bracovirus
LPLGNP

SEQ ID NO: 1492 - protein, 6 aa, Campoletis sonorensis ichnovirus
MANWDY

SEQ ID NO: 1493 - protein, 6 aa, Campoletis sonorensis ichnovirus
MANWDY

SEQ ID NO: 1494 - protein, 6 aa, Campoletis sonorensis ichnovirus
IGNETN

SEQ ID NO: 1495 - protein, 6 aa, Campoletis sonorensis ichnovirus
IVNETN

SEQ ID NO: 1496 - protein, 6 aa, Campoletis sonorensis ichnovirus
IKHYHR

SEQ ID NO: 1497 - protein, 6 aa, Campoletis sonorensis ichnovirus
IPNWSN

SEQ ID NO: 1498 - protein, 6 aa, Campoletis sonorensis ichnovirus
LVPSHR

SEQ ID NO: 1499 - protein, 6 aa, Campoletis sonorensis ichnovirus
IAYNDY

SEQ ID NO: 1500 - protein, 6 aa, Campoletis chlorideae ichnovirus
IGNYQP

SEQ ID NO: 1501 - protein, 6 aa, Campoletis sonorensis ichnovirus
IGHYQK

SEQ ID NO: 1502 - protein, 6 aa, Campoletis sp. Ichnovirus
IKQFDH

SEQ ID NO: 1503 - protein, 6 aa, Campoletis sonorensis ichnovirus
IGNYQP

SEQ ID NO: 1504 - protein, 6 aa, Ectoropis oblique NPV
TETGRN

SEQ ID NO: 1505 - protein, 6 aa, Antheraea pernyi nuclear polyhedrosis virus
TEDGRN

SEQ ID NO: 1506 - protein, 6 aa, Helicoverpa armigera granulovirus
TETGRN

SEQ ID NO: 1507 - protein, 6 aa, Orgyia leucostigma NPV
AETGAV

SEQ ID NO: 1508 - protein, 6 aa, Orgyia pseudotsugata multicapsid polyhedrosis virus
TETGRN

SEQ ID NO: 1509 - protein, 6 aa, Autographa californica nuclear polyhedrosis virus
AETGAV

SEQ ID NO: 1510 - protein, 6 aa, Anticarsia gemmatalis nuclear polyhedrosis virus
TETGRN

SEQ ID NO: 1511 - protein, 6 aa, Plutella xylostella multiple nucleopolyhedrovirus
AETGAV

SEQ ID NO: 1512 - protein, 6 aa, Antheraea pernyi nuclear polyhedrosis virus
AETGAV

SEQ ID NO: 1513 - protein, 6 aa, Mamestra configurata NPV-B
TETGRN

SEQ ID NO: 1514 - protein, 6 aa, Mamestra configurata NPV-A
TDTGRN

SEQ ID NO: 1515 - protein, 6 aa, Xestia c-nigrum granulosis virus
TETGRN

SEQ ID NO: 1516 - protein, 3 aa, Hybanthus parviflorus
AES

SEQ ID NO: 1517 - protein, 3 aa, Chassalia parvifolia
GES

SEQ ID NO: 1518 - protein, 3 aa, Viola baoshanensis
AES

SEQ ID NO: 1519 - protein, 3 aa, Viola baoshanensis
AES

SEQ ID NO: 1520 - protein, 3 aa, Viola baoshanensis
AES

SEQ ID NO: 1521 - protein, 3 aa, Viola baoshanensis
AES

SEQ ID NO: 1522 - protein, 3 aa, Viola baoshanensis
AES

SEQ ID NO: 1523 - protein, 3 aa, Viola baoshanensis
GES

SEQ ID NO: 1524 - protein, 3 aa, Viola baoshanensis
GES

SEQ ID NO: 1525 - protein, 3 aa, Viola baoshanensis
AES

SEQ ID NO: 1526 - protein, 3 aa, Oldenlandia affinis
AES

SEQ ID NO: 1527 - protein, 3 aa, Oldenlandia affinis
AES

SEQ ID NO: 1528 - protein, 3 aa, Melicytus ramiflorus
GES

SEQ ID NO: 1529 - protein, 3 aa, Viola hederacea
AES

SEQ ID NO: 1530 - protein, 3 aa, Viola biflora
AES

SEQ ID NO: 1531 - protein, 3 aa, Viola odorata
GET

SEQ ID NO: 1532 - protein, 3 aa, Hybanthus floribundus E
GES

SEQ ID NO: 1533 - protein, 3 aa, Hybanthus floribundus E
GET

SEQ ID NO: 1534 - protein, 3 aa, Hybanthus floribundus E
GES

SEQ ID NO: 1535 - protein, 3 aa, Hybanthus floribundus E
GES

SEQ ID NO: 1536 - protein, 3 aa, Hybanthus floribundus E
GES

SEQ ID NO: 1537 - protein, 3 aa, Hybanthus floribundus E
AES

SEQ ID NO: 1538 - protein, 3 aa, Chassalia parvifolia
GES

SEQ ID NO: 1539 - protein, 3 aa, Chassalia parvifolia
GES

SEQ ID NO: 1540 - protein, 3 aa, Chassalia parvifolia
GES

SEQ ID NO: 1541 - protein, 3 aa, Chassalia parvifolia
GES

SEQ ID NO: 1542 - protein, 3 aa, Psychotria longipes
GES

SEQ ID NO: 1543 - protein, 3 aa, Viola baoshanensis
GES

SEQ ID NO: 1544 - protein, 3 aa, Viola baoshanensis
GES

SEQ ID NO: 1545 - protein, 3 aa, Viola baoshanensis
GES

SEQ ID NO: 1546 - protein, 3 aa, Viola baoshanensis
IET

SEQ ID NO: 1547 - protein, 3 aa, Viola baoshanensis
GES

SEQ ID NO: 1548 - protein, 3 aa, Viola baoshanensis
GES

SEQ ID NO: 1549 - protein, 3 aa, Viola baoshanensis
GES

SEQ ID NO: 1550 - protein, 3 aa, Viola baoshanensis
GER

SEQ ID NO: 1551 - protein, 3 aa, Viola baoshanensis
GEG

SEQ ID NO: 1552 - protein, 3 aa, Viola baoshanensis
GES

SEQ ID NO: 1553 - protein, 3 aa, Viola baoshanensis
GES

SEQ ID NO: 1554 - protein, 3 aa, Viola baoshanensis
GES

SEQ ID NO: 1555 - protein, 3 aa, Viola baoshanensis
GES

SEQ ID NO: 1556 - protein, 3 aa, Viola baoshanensis
GES

SEQ ID NO: 1557 - protein, 3 aa, Viola baoshanensis
GES

SEQ ID NO: 1558 - protein, 3 aa, Viola baoshanensis
GES

SEQ ID NO: 1559 - protein, 3 aa, Viola baoshanensis
GET

SEQ ID NO: 1560 - protein, 3 aa, Viola baoshanensis
GES

SEQ ID NO: 1561 - protein, 3 aa, Viola baoshanensis
GES

SEQ ID NO: 1562 - protein, 3 aa, Viola baoshanensis
GES

SEQ ID NO: 1563 - protein, 3 aa, Viola baoshanensis
GES

SEQ ID NO: 1564 - protein, 3 aa, Viola baoshanensis
GES

SEQ ID NO: 1565 - protein, 3 aa, Leonia cymosa
GES

SEQ ID NO: 1566 - protein, 3 aa, Leonia cymosa
GES

SEQ ID NO: 1567 - protein, 3 aa, Leonia cymosa
GES

SEQ ID NO: 1568 - protein, 3 aa, Hedyotis centranthoides
GES

SEQ ID NO: 1569 - protein, 3 aa, Hedyotis terminalis
GDS

SEQ ID NO: 1570 - protein, 3 aa, Oldenlandia affinis
GDT

SEQ ID NO: 1571 - protein, 3 aa, Oldenlandia affinis
AES

SEQ ID NO: 1572 - protein, 3 aa, Oldenlandia affinis
GES

SEQ ID NO: 1573 - protein, 3 aa, Melicytus ramiflorus
AES

SEQ ID NO: 1574 - protein, 3 aa, Melicytus ramiflorus
GES

SEQ ID NO: 1575 - protein, 3 aa, Melicytus ramiflorus
GES

SEQ ID NO: 1576 - protein, 3 aa, Viola hederacea
GES

SEQ ID NO: 1577 - protein, 3 aa, Viola biflora
GES

SEQ ID NO: 1578 - protein, 3 aa, Viola biflora
GES

SEQ ID NO: 1579 - protein, 3 aa, Viola tricolor
GES

SEQ ID NO: 1580 - protein, 3 aa, Hybathus floribundus E
GES

SEQ ID NO: 1581 - protein, 3 aa, Hybathus floribundus E
GES

SEQ ID NO: 1582 - protein, 3 aa, Hybathus floribundus E
GES

SEQ ID NO: 1583 - protein, 3 aa, Psychotria suterella
GET

SEQ ID NO: 1584 - protein, 3 aa, Chassalia parvifolia
GES

SEQ ID NO: 1585 - protein, 3 aa, Viola baoshanensis
GES

SEQ ID NO: 1586 - protein, 3 aa, Viola baoshanensis
GET

SEQ ID NO: 1587 - protein, 3 aa, Viola baoshanensis
GET

SEQ ID NO: 1588 - protein, 3 aa, Viola baoshanensis
GET

SEQ ID NO: 1589 - protein, 3 aa, Viola hederacea
GES

SEQ ID NO: 1590 - protein, 3 aa, Viola hederacea
GET

SEQ ID NO: 1591 - protein, 3 aa, Viola odorata
GES

SEQ ID NO: 1592 - protein, 3 aa, Viola odorata
GET

SEQ ID NO: 1593 - protein, 3 aa, Viola odorata
GET

SEQ ID NO: 1594 - protein, 3 aa, Viola odorata
GET

SEQ ID NO: 1595 - protein, 3 aa, Viola odorata
GES

SEQ ID NO: 1596 - protein, 3 aa, Viola odorata
GET

SEQ ID NO: 1597 - protein, 3 aa, Viola odorata
GET

SEQ ID NO: 1598 - protein, 3 aa, Viola odorata
GET

SEQ ID NO: 1599 - protein, 3 aa, Viola odorata
GET

SEQ ID NO: 1600 - protein, 3 aa, Viola odorata
GES

SEQ ID NO: 1601 - protein, 3 aa, Viola odorata
GES

SEQ ID NO: 1602 - protein, 3 aa, Leonia cymosa
GES

SEQ ID NO: 1603 - protein, 3 aa, Oldenlandia affinis
GET

SEQ ID NO: 1604 - protein, 3 aa, Oldenlandia affinis
GET

SEQ ID NO: 1605 - protein, 3 aa, Oldenlandia affinis
GET

SEQ ID NO: 1606 - protein, 3 aa, Oldenlandia affinis
GET

SEQ ID NO: 1607 - protein, 3 aa, Oldenlandia affinis
GET

SEQ ID NO: 1608 - protein, 3 aa, Oldenlandia affinis
GES

SEQ ID NO: 1609 - protein, 3 aa, Oldenlandia affinis
GES

SEQ ID NO: 1610 - protein, 3 aa, Oldenlandia affinis
GET

SEQ ID NO: 1611 - protein, 3 aa, Oldenlandia affinis
GET

SEQ ID NO: 1612 - protein, 3 aa, Oldenlandia affinis
GET

SEQ ID NO: 1613 - protein, 3 aa, Oldenlandia affinis
GET

SEQ ID NO: 1614 - protein, 3 aa, Oldenlandia affinis
GET

SEQ ID NO: 1615 - protein, 3 aa, Oldenlandia affinis
GET

SEQ ID NO: 1616 - protein, 3 aa, Melicytus ramiflorus
GES

SEQ ID NO: 1617 - protein, 3 aa, Melicytus ramiflorus
GES

SEQ ID NO: 1618 - protein, 3 aa, Melicytus ramiflorus
GET

SEQ ID NO: 1619 - protein, 3 aa, Melicytus ramiflorus
GET

SEQ ID NO: 1620 - protein, 3 aa, Melicytus ramiflorus
GEG

SEQ ID NO: 1621 - protein, 3 aa, Melicytus ramiflorus
GES

SEQ ID NO: 1622 - protein, 3 aa, Melicytus ramiflorus
GES

SEQ ID NO: 1623 - protein, 3 aa, Melicytus ramiflorus
GES

SEQ ID NO: 1624 - protein, 3 aa, Melicytus ramiflorus
GES

SEQ ID NO: 1625 - protein, 3 aa, Viola odorata
GET

SEQ ID NO: 1626 - protein, 3 aa, Viola odorata
GET

SEQ ID NO: 1627 - protein, 3 aa, Viola odorata
GET

SEQ ID NO: 1628 - protein, 3 aa, Viola odorata
GET

SEQ ID NO: 1629 - protein, 3 aa, Viola odorata
GET

SEQ ID NO: 1630 - protein, 3 aa, Viola odorata
GET

SEQ ID NO: 1631 - protein, 3 aa, Viola odorata
GET

SEQ ID NO: 1632 - protein, 3 aa, Viola odorata
GET

SEQ ID NO: 1633 - protein, 3 aa, Viola hederacea
GET

SEQ ID NO: 1634 - protein, 3 aa, Viola biflora
GET

SEQ ID NO: 1635 - protein, 3 aa, Viola biflora
GET

SEQ ID NO: 1636 - protein, 3 aa, Viola biflora
GET

SEQ ID NO: 1637 - protein, 3 aa, Viola biflora
GET

SEQ ID NO: 1638 - protein, 3 aa, Viola biflora
GES

SEQ ID NO: 1639 - protein, 3 aa, Viola biflora
GES

SEQ ID NO: 1640 - protein, 3 aa, Viola biflora
AES

SEQ ID NO: 1641 - protein, 3 aa, Viola biflora
GES

SEQ ID NO: 1642 - protein, 3 aa, Viola cotyledon
AES

SEQ ID NO: 1643 - protein, 3 aa, Viola cotyledon
AES

SEQ ID NO: 1644 - protein, 3 aa, Viola arvensis
GET

SEQ ID NO: 1645 - protein, 3 aa, Viola odorata
GES

SEQ ID NO: 1646 - protein, 3 aa, Viola odorata
GET

SEQ ID NO: 1647 - protein, 3 aa, Chassalia discolor
GES

SEQ ID NO: 1648 - protein, 3 aa, Hybanthus floribundus E
AET

SEQ ID NO: 1649 - protein, 3 aa, Hybanthus floribundus E
AET

SEQ ID NO: 1650 - protein, 3 aa, Viola odorata
GES

SEQ ID NO: 1651 - protein, 3 aa, Oldenlandia affinis
GET

SEQ ID NO: 1652 - protein, 3 aa, Oldenlandia affinis
GET

SEQ ID NO: 1653 - protein, 3 aa, Oldenlandia affinis
GET

SEQ ID NO: 1654 - protein, 3 aa, Melcytus ramiflorus
GES

SEQ ID NO: 1655 - protein, 3 aa, Palicourea condensata
GET

SEQ ID NO: 1656 - protein, 3 aa, Viola yedoensis
GET

SEQ ID NO: 1657 - protein, 3 aa, Viola yedoensis
GES

SEQ ID NO: 1658 - protein, 3 aa, Viola yedoensis
GET

SEQ ID NO: 1659 - protein, 3 aa, Viola arvensis
GES

SEQ ID NO: 1660 - protein, 3 aa, Viola arvensis
GES

SEQ ID NO: 1661 - protein, 11 aa, Tachypleus tridentatus
VVRSYGLPTIP

SEQ ID NO: 1662 - protein, 11 aa, Tachypleus tridentatus
VVRSYGLPTIP

SEQ ID NO: 1663 - protein, 7 aa, Tachypleus tridentatus
RVYSGRS

SEQ ID NO: 1664 - protein, 7 aa, Tachypleus tridentatus
RVYSGRS

SEQ ID NO: 1665 - protein, 6 aa, Takifugu rubripes
KSPGTE

SEQ ID NO: 1666 - protein, 5 aa, Takifugu rubripes
VPQFG

SEQ ID NO: 1667 - protein, 6 aa, Takifugu rubripes
LGYPLP

SEQ ID NO: 1668 - protein, 5 aa, Takifugu rubripes
SPYTP

SEQ ID NO: 1669 - protein, 6 aa, Aotus sp. Aot1
KPPAPA

SEQ ID NO: 1670 - protein, 6 aa, Mus musculus
KPPAPA

SEQ ID NO: 1671 - protein, 6 aa, Canis lupus
KSPAPA

SEQ ID NO: 1672 - protein, 6 aa, Tetrao urogallus
LGHQIP

SEQ ID NO: 1673 - protein, 6 aa, Tragopan temminckii
LGHQIP

SEQ ID NO: 1674 - protein, 6 aa, Tragopan satyra
LGHQIP

SEQ ID NO: 1675 - protein, 6 aa, Syrmaticus reevesii
LGHQIP

SEQ ID NO: 1676 - protein, 6 aa, Rollulus roulroul
LGHQIP

SEQ ID NO: 1677 - protein, 6 aa, Perdix perdix
LGHQIP

SEQ ID NO: 1678 - protein, 6 aa, Polyplectron malacense
LGHQIP

SEQ ID NO: 1679 - protein, 6 aa, Pavo muticus
LGHQIP

SEQ ID NO: 1680 - protein, 6 aa, Polyplectron inopinatum
LGHQIP

SEQ ID NO: 1681 - protein, 6 aa, Polyplectron napolenois
LGHQIP

SEQ ID NO: 1682 - protein, 6 aa, Phasianus colchincus
LGHQIP

SEQ ID NO: 1683 - protein, 6 aa, Pavo cristatus
LGHQIP

SEQ ID NO: 1684 - protein, 6 aa, Melegaris gallopavo
LGHQIP

SEQ ID NO: 1685 - protein, 6 aa, Tetrao tetrix
LGHQIP

SEQ ID NO: 1686 - protein, 6 aa, Lophura nycthemera
LGHQIP

SEQ ID NO: 1687 - protein, 6 aa, Lagopus lagopus scotica
LGHQIP

SEQ ID NO: 1688 - protein, 6 aa, Lophophorus impejanus
LGHQIP

SEQ ID NO: 1689 - protein, 6 aa, Lophura edwardsi
LGHQIP

SEQ ID NO: 1690 - protein, 6 aa, Lophura diardi
LGHQIP

SEQ ID NO: 1691 - protein, 6 aa, Gallus sonneratii
LGHQIP

SEQ ID NO: 1692 - protein, 6 aa, Francolinus pondicerianus
LGHQIP

SEQ ID NO: 1693 - protein, 6 aa, Francolinus levaillantii
LGHQIP

SEQ ID NO: 1694 - protein, 6 aa, Catreus wallichii
LGHQIP

SEQ ID NO: 1695 - protein, 6 aa, Crossoptilon mantchuricum
LGHQIP

SEQ ID NO: 1696 - protein, 6 aa, Coturnix coturnix japonica
LGHQIP

SEQ ID NO: 1697 - protein, 6 aa, Coturnix coturnix
LGHQIP

SEQ ID NO: 1698 - protein, 6 aa, Crossoptilon crossoptilon
LGHQIP

SEQ ID NO: 1699 - protein, 6 aa, Alectoris chukar
LGHQIP

SEQ ID NO: 1700 - protein, 6 aa, Afropavo congensis
LGHQIP

SEQ ID NO: 1701 - protein, 6 aa, Argusianus argus
LGHQIP

SEQ ID NO: 1702 - protein, 6 aa, Alectoris rufa
LGHQIP

SEQ ID NO: 1703 - protein, 6 aa, Peromyscus maniculatus
KPPAPA

SEQ ID NO: 1704 - protein, 6 aa, Peromyscus polionotus subgriseus
KPPAPA

SEQ ID NO: 1705 - protein, 6 aa, Peromyscus polionotus leucocephalus
KPPAPA

SEQ ID NO: 1706 - protein, 6 aa, Coturnix coturnix japonica
KPHLNS

SEQ ID NO: 1707 - protein, 6 aa, Coturnix coturnix japonica
KPHLNS

SEQ ID NO: 1708 - protein, 6 aa, Capra hircus
KPPAPA

SEQ ID NO: 1709 - protein, 6 aa, Bos taurus
LGHQVP

SEQ ID NO: 1710 - protein, 6 aa, Homo sapiens
LGQQVP

SEQ ID NO: 1711 - protein, 6 aa, Mus musculus
LGQQVP

SEQ ID NO: 1712 - protein, 6 aa, Sus scrofa
LGHQVP

SEQ ID NO: 1713 - protein, 6 aa, Bos taurus
KPPAPA

SEQ ID NO: 1714 - protein, 6 aa, Callithrix geoffroyi
KPPAPA

SEQ ID NO: 1715 - protein, 6 aa, Callimico goeldii
KPPAPA

SEQ ID NO: 1716 - protein, 6 aa, Callithrix jacchus
KPPAPA

SEQ ID NO: 1717 - protein, 6 aa, Canis familiaris
KSPAPA

SEQ ID NO: 1718 - protein, 6 aa, Cebuella pygmaea
KPPAPA

SEQ ID NO: 1719 - protein, 6 aa, Chlorocebus aethiops
KPPAPA

SEQ ID NO: 1720 - protein, 6 aa, Cercopithecus mitis
KPPAPA

SEQ ID NO: 1721 - protein, 6 aa, Colobus polykomos
KPPAPA

SEQ ID NO: 1722 - protein, 6 aa, Erythrocebus patas
KPPAPA

SEQ ID NO: 1723 - protein, 6 aa, Felis catus
KPPAPA

SEQ ID NO: 1724 - protein, 6 aa, Gorilla gorilla gorilla
KPPAPA

SEQ ID NO: 1725 - protein, 6 aa, Equus caballus
KPPAPA

SEQ ID NO: 1726 - protein, 6 aa, Homo sapiens
KPPAPA

SEQ ID NO: 1727 - protein, 6 aa, Leontopithecus chrysomelas
KPPAPA

SEQ ID NO: 1728 - protein, 6 aa, Leontopithecus rosalia
KPPAPA

SEQ ID NO: 1729 - protein, 6 aa, Macaca arctoides
KPPAPA

SEQ ID NO: 1730 - protein, 6 aa, Macaca assamensis
KPPAPA

SEQ ID NO: 1731 - protein, 6 aa, Macaca cyclopis
KPPAPA

SEQ ID NO: 1732 - protein, 6 aa, Macaca fascicularis
KPPAPA

SEQ ID NO: 1733 - protein, 6 aa, Macaca fuscata fuscata
KPPAPA

SEQ ID NO: 1734 - protein, 6 aa, Macaca hecki
KPPAPA

SEQ ID NO: 1735 - protein, 6 aa, Macaca maura
KPPAPA

SEQ ID NO: 1736 - protein, 6 aa, Macaca mulatta
KPPAPA

SEQ ID NO: 1737 - protein, 6 aa, Macaca nemestrina
KPPAPA

SEQ ID NO: 1738 - protein, 6 aa, Macaca nigra
KSPAPA

SEQ ID NO: 1739 - protein, 6 aa, Macaca nigrescens
KPPAPA

SEQ ID NO: 1740 - protein, 6 aa, Macaca radiata
KPPAPA

SEQ ID NO: 1741 - protein, 6 aa, Macaca sinica
KPPAPA

SEQ ID NO: 1742 - protein, 6 aa, Macaca silenus
KPPAPA

SEQ ID NO: 1743 - protein, 6 aa, Macaca sylvanus
KPPAPA

SEQ ID NO: 1744 - protein, 6 aa, Mus musculus
KPPAPA

SEQ ID NO: 1745 - protein, 6 aa, Pan paniscus
KPPAPA

SEQ ID NO: 1746 - protein, 6 aa, Pan troglodytes
KPPAPA

SEQ ID NO: 1747 - protein, 6 aa, Papio anubis
KPPAPA

SEQ ID NO: 1748 - protein, 6 aa, Sus scrofa
KPPALA

SEQ ID NO: 1749 - protein, 6 aa, Pongo pygmaeus
KPPAPA

SEQ ID NO: 1750 - protein, 6 aa, Rattus norvegicus
KPPAPA

SEQ ID NO: 1751 - protein, 6 aa, Semnopithecus entellus
KPPAPA

SEQ ID NO: 1752 - protein, 6 aa, Trachypithecus auratus
KPPAPA

SEQ ID NO: 1753 - protein, 6 aa, Trachypithecus cristatus
KPPAPA

SEQ ID NO: 1754 - protein, 6 aa, Trachypithecus francoisi
KPPAPA

SEQ ID NO: 1755 - protein, 6 aa, Trachypithecus obscurus
KPPAPA

SEQ ID NO: 1756 - protein, 6 aa, Vulpes vulpes
KSPAPA

SEQ ID NO: 1757 - protein, 6 aa, Oryctolagus cuniculus
KPPAPV

SEQ ID NO: 1758 - protein, 6 aa, Coturnix coturnix japonica
KPHLNS

SEQ ID NO: 1759 - protein, 6 aa, Gallus gallus
KPHLNS

SEQ ID NO: 1760 - protein, 6 aa, Gallus gallus
KPHLNS

SEQ ID NO: 1761 - protein, 6 aa, Gallus gallus
KPHLNS

SEQ ID NO: 1762 - protein, 6 aa, Mus musculus
LGQQVP

SEQ ID NO: 1763 - protein, 6 aa, Capra hircus
KPPAPA

SEQ ID NO: 1764 - protein, 6 aa, Tetraodon nigroviridis
LGYPLP

SEQ ID NO: 1765 - protein, 5 aa, Tetraodon nigroviridis
SPYMP

SEQ ID NO: 1766 - protein, 6 aa, Carassius auratus
KTPSAA

SEQ ID NO: 1767 - protein, 6 aa, Carassius auratus
KTPSAA

SEQ ID NO: 1768 - protein, 6 aa, Carassius auratus
KTPSAA

SEQ ID NO: 1769 - protein, 6 aa, Canis familiaris
KSPAPA

SEQ ID NO: 1770 - protein, 6 aa, Canis lupus
KSPAPA

SEQ ID NO: 1771 - protein, 6 aa, Canis latrans
KSPAPA

SEQ ID NO: 1772 - protein, 6 aa, Ovis aries
LGHQVP

SEQ ID NO: 1773 - protein, 6 aa, Carassius auratus
LGHHLP

SEQ ID NO: 1774 - protein, 6 aa, Carassius auratus
LGHHLP

SEQ ID NO: 1775 - protein, 6 aa, Coturnix coturnix japonica
LGHQIP

SEQ ID NO: 1776 - protein, 6 aa, Sus scrofa
LGHQVP

SEQ ID NO: 1777 - protein, 6 aa, Gallus gallus
LGHQIP

SEQ ID NO: 1778 - protein, 6 aa, Rattus norvegicus
LGQQVP

SEQ ID NO: 1779 - protein, 6 aa, Gallus gallus
LGHQIP

SEQ ID NO: 1780 - protein, 8 aa, Amaranthus hypochondriacus
GPKMDGVP

SEQ ID NO: 1781 - protein, 6 aa, Agriosphodrus dohrni
LGENKQ

SEQ ID NO: 1782 - protein, 6 aa, Isyndus obscurs
LGENKQ

SEQ ID NO: 1783 - protein, 6 aa, Peirates turpis
FGTDKP

SEQ ID NO: 1784 - protein, 8 aa, Conus vexillum
DAFHHAAV

SEQ ID NO: 1785 - protein, 5 aa, Conus abbreviates
FGPAA

SEQ ID NO: 1786 - protein, 5 aa, Conus abbreviates
GGHAH

SEQ ID NO: 1787 - protein, 5 aa, Conus abbreviates
GGHAH

SEQ ID NO: 1788 - protein, 5 aa, Conus abbreviates
FYSYF

SEQ ID NO: 1789 - protein, 5 aa, Conus abbreviates
LFAYE

SEQ ID NO: 1790 - protein, 5 aa, Conus abbreviates
YHPDP

SEQ ID NO: 1791 - protein, 5 aa, Conus abbreviates
YHPDP

SEQ ID NO: 1792 - protein, 5 aa, Conus abbreviates
YAAYT

SEQ ID NO: 1793 - protein, 5 aa, Conus abbreviates
YADNT

SEQ ID NO: 1794 - protein, 5 aa, Conus abbreviates
DATTK

SEQ ID NO: 1795 - protein, 5 aa, Conus abbreviates
DATTE

SEQ ID NO: 1796 - protein, 5 aa, Conus abbreviates
DATTE

SEQ ID NO: 1797 - protein, 5 aa, Conus abbreviates
DATTE

SEQ ID NO: 1798 - protein, 5 aa, Conus abbreviates
DATTN

SEQ ID NO: 1799 - protein, 5 aa, Conus abbreviates
VRDTS

SEQ ID NO: 1800 - protein, 5 aa, Conus abbreviates
VRDTS

SEQ ID NO: 1801 - protein, 5 aa, Conus abbreviates
VRDTS

SEQ ID NO: 1802 - protein, 6 aa, Conus aurisiacus
GIHPGL

SEQ ID NO: 1803 - protein, 6 aa, Conus ammiralis
NLLDQN

SEQ ID NO: 1804 - protein, 6 aa, Conus ammiralis
DVIDPD

SEQ ID NO: 1805 - protein, 5 aa, Conus ammiralis
NTGNQ

SEQ ID NO: 1806 - protein, 6 aa, Conus amadis
DIFSQN

SEQ ID NO: 1807 - protein, 6 aa, Conus arenatus
DPSAGN

SEQ ID NO: 1808 - protein, 4 aa, Conus arenatus
YTRF

SEQ ID NO: 1809 - protein, 4 aa, Conus arenatus
ATRP

SEQ ID NO: 1810 - protein, 4 aa, Conus arenatus
SAHR

SEQ ID NO: 1811 - protein, 6 aa, Conus arenatus
IPATHD

SEQ ID NO: 1812 - protein, 5 aa, Conus arenatus
SRHHH

SEQ ID NO: 1813 - protein, 5 aa, Conus arenatus
FDHHH

SEQ ID NO: 1814 - protein, 5 aa, Conus arenatus
SRHYH

SEQ ID NO: 1815 - protein, 5 aa, Conus arenatus
SRHYH

SEQ ID NO: 1816 - protein, 5 aa, Conus arenatus
SRHYH

SEQ ID NO: 1817 - protein, 6 aa, Conus arenatus
DPDNHD

SEQ ID NO: 1818 - protein, 8 aa, Conus arenatus
GFPKIGGP

SEQ ID NO: 1819 - protein, 6 aa, Conus arenatus
EEEEKT

SEQ ID NO: 1820 - protein, 6 aa, Conus arenatus
EDEEKT

SEQ ID NO: 1821 - protein, 6 aa, Conus arenatus
EEEEKT

SEQ ID NO: 1822 - protein, 6 aa, Conus arenatus
EDEEKT

SEQ ID NO: 1823 - protein, 6 aa, Conus arenatus
EEEEKH

SEQ ID NO: 1824 - protein, 6 aa, Conus arenatus
EEEEKH

SEQ ID NO: 1825 - protein, 6 aa, Conus arenatus
EDEEKH

SEQ ID NO: 1826 - protein, 6 aa, Conus arenatus
EEEEKT

SEQ ID NO: 1827 - protein, 9 aa, Conus arenatus
GLPYVHNSR

SEQ ID NO: 1828 - protein, 6 aa, Conus arenatus
TMADDE

SEQ ID NO: 1829 - protein, 6 aa, Conus arenatus
TMDDDE

SEQ ID NO: 1830 - protein, 6 aa, Conus arenatus
TMDDDE

SEQ ID NO: 1831 - protein, 6 aa, Conus arenatus
NMVDDE

SEQ ID NO: 1832 - protein, 6 aa, Conus arenatus
NMADDD

SEQ ID NO: 1833 - protein, 4 aa, Conus arenatus
HTRF

SEQ ID NO: 1834 - protein, 5 aa, Conus austini
SLDVE

SEQ ID NO: 1835 - protein, 5 aa, Conus Aristophanes
VGPST

SEQ ID NO: 1836 - protein, 5 aa, Conus Aristophanes
YHPYY

SEQ ID NO: 1837 - protein, 5 aa, Conus Aristophanes
DATTN

SEQ ID NO: 1838 - protein, 5 aa, Conus Aristophanes
NTPPQ

SEQ ID NO: 1839 - protein, 5 aa, Conus Aristophanes
AGHHH

SEQ ID NO: 1840 - protein, 5 aa, Conus Aristophanes
YYHSQ

SEQ ID NO: 1841 - protein, 5 aa, Conus Aristophanes
NHPSH

SEQ ID NO: 1842 - protein, 5 aa, Conus Aristophanes
TYHRD

SEQ ID NO: 1843 - protein, 6 aa, Conus aulicus
NIFIQN

SEQ ID NO: 1844 - protein, 6 aa, Conus aulicus
NFFFPT

SEQ ID NO: 1845 - protein, 8 aa, Conus aulicus
GMIKIGPP

SEQ ID NO: 1846 - protein, 6 aa, Conus bullatus
LIRPGL

SEQ ID NO: 1847 - protein, 5 aa, Conus betulinus
TRHYH

SEQ ID NO: 1848 - protein, 5 aa, Conus betulinus
SWDWE

SEQ ID NO: 1849 - protein, 6 aa, Conus radiates
NVTFKT

SEQ ID NO: 1850 - protein, 6 aa, Conus catus
GIHPGL

SEQ ID NO: 1851 - protein, 6 aa, Conus catus
RRTSYD

SEQ ID NO: 1852 - protein, 6 aa, Conus catus
RRTSYG

SEQ ID NO: 1853 - protein, 6 aa, Conus catus
RRTPYD

SEQ ID NO: 1854 - protein, 6 aa, Conus catus
RKTMYN

SEQ ID NO: 1855 - protein, 6 aa, Conus catus
RKTSYD

SEQ ID NO: 1856 - protein, 6 aa, Conus catus
RRTSYD

SEQ ID NO: 1857 - protein, 6 aa, Conus catus
RRTSYD

SEQ ID NO: 1858 - protein, 6 aa, Conus catus
RRTSYD

SEQ ID NO: 1859 - protein, 6 aa, Conus catus
RKTMYD

SEQ ID NO: 1860 - protein, 6 aa, Conus catus
SKLMYD

SEQ ID NO: 1861 - protein, 6 aa, Conus catus
SKLMYD

SEQ ID NO: 1862 - protein, 6 aa, Conus catus
GIHPGL

SEQ ID NO: 1863 - protein, 6 aa, Conus caracteristicus
GPGFGD

SEQ ID NO: 1864 - protein, 6 aa, Conus caracteristicus
EDEEKH

SEQ ID NO: 1865 - protein, 6 aa, Conus capitaneus
TNTSPP

SEQ ID NO: 1866 - protein, 6 aa, Conus consors
GIRPGL

SEQ ID NO: 1867 - protein, 6 aa, Conus consors
GINGGL

SEQ ID NO: 1868 - protein, 6 aa, Conus consors
TRLMYD

SEQ ID NO: 1869 - protein, 5 aa, Conus coronatus
TGHSD

SEQ ID NO: 1870 - protein, 5 aa, Conus coronatus
FYSYF

SEQ ID NO: 1871 - protein, 5 aa, Conus coronatus
YSAST

SEQ ID NO: 1872 - protein, 5 aa, Conus coronatus
RFSYE

SEQ ID NO: 1873 - protein, 5 aa, Conus coronatus
DATAT

SEQ ID NO: 1874 - protein, 5 aa, Conus coronatus
GNPGH

SEQ ID NO: 1875 - protein, 5 aa, Conus coronatus
AGDAS

SEQ ID NO: 1876 - protein, 5 aa, Conus virgo
SSDSE

SEQ ID NO: 1877 - protein, 4 aa, Conus virgo
YTQP

SEQ ID NO: 1878 - protein, 4 aa, Conus virgo
YTQP

SEQ ID NO: 1879 - protein, 5 aa, Conus virgo
GVTSI

SEQ ID NO: 1880 - protein, 4 aa, Conus virgo
YTQP

SEQ ID NO: 1881 - protein, 9 aa, Conus virgo
GFGLFGGPL

SEQ ID NO: 1882 - protein, 5 aa, Conus virgo
GIYND

SEQ ID NO: 1883 - protein, 7 aa, Conus virgo
GTLYEER

SEQ ID NO: 1884 - protein, 7 aa, Conus virgo
GTLYEER

SEQ ID NO: 1885 - protein, 4 aa, Conus virgo
YTQP

SEQ ID NO: 1886 - protein, 6 aa, Conus virgo
GIHPGL

SEQ ID NO: 1887 - protein, 8 aa, Conus ventricosus
VFWNIGRP

SEQ ID NO: 1888 - protein, 6 aa, Conus dalli
DLIFQN

SEQ ID NO: 1889 - protein, 6 aa, Conus dalli
DPLSQN

SEQ ID NO: 1890 - protein, 6 aa, Conus dalli
DIFFPQ

SEQ ID NO: 1891 - protein, 6 aa, Conus dalli
DALDSD

SEQ ID NO: 1892 - protein, 5 aa, Conus dalli
DSGNQ

SEQ ID NO: 1893 - protein, 9 aa, Conus dalli
PVPFLGSRY

SEQ ID NO: 1894 - protein, 9 aa, Conus dalli
IVPVLGFVY

SEQ ID NO: 1895 - protein, 7 aa, Conus delessertii
DVFRPYR

SEQ ID NO: 1896 - protein, 7 aa, Conus delessertii
AITEMAE

SEQ ID NO: 1897 - protein, 6 aa, Conus distans
LMLYSD

SEQ ID NO: 1898 - protein, 6 aa, Conus distans
GINGGL

SEQ ID NO: 1899 - protein, 5 aa, Conus distans
TQNPD

SEQ ID NO: 1900 - protein, 6 aa, Conus ermineus
FPHQKD

SEQ ID NO: 1901 - protein, 5 aa, Conus ermineus
GLVST

SEQ ID NO: 1902 - protein, 9 aa, Conus ermineus
SLPILKNGL

SEQ ID NO: 1903 - protein, 6 aa, Conus ermineus
GIKPGL

SEQ ID NO: 1904 - protein, 5 aa, Conus ebraeus
NSHDQ

SEQ ID NO: 1905 - protein, 5 aa, Conus ebraeus
NSHTQ

SEQ ID NO: 1906 - protein, 5 aa, Conus ebraeus
NSHTQ

SEQ ID NO: 1907 - protein, 5 aa, Conus ebraeus
NSHTQ

SEQ ID NO: 1908 - protein, 5 aa, Conus ebraeus
YHRDT

SEQ ID NO: 1909 - protein, 5 aa, Conus ebraeus
NSHDQ

SEQ ID NO: 1910 - protein, 5 aa, Conus ebraeus
NSHDQ

SEQ ID NO: 1911 - protein, 5 aa, Conus ebraeus
NSHDQ

SEQ ID NO: 1912 - protein, 5 aa, Conus ebraeus
NSHDQ

SEQ ID NO: 1913 - protein, 5 aa, Conus ebraeus
NSHNQ

SEQ ID NO: 1914 - protein, 5 aa, Conus ebraeus
NSHTQ

SEQ ID NO: 1915 - protein, 5 aa, Conus ebraeus
NSHTQ

SEQ ID NO: 1916 - protein, 6 aa, Conus episcopatus
LMLYSD

SEQ ID NO: 1917 - protein, 8 aa, Conus geographus
GFFKIGPP

SEQ ID NO: 1918 - protein, 6 aa, Conus geographus
SPTSYN

SEQ ID NO: 1919 - protein, 6 aa, Conus geographus
SRGMRD

SEQ ID NO: 1920 - protein, 6 aa, Conus geographus
SRGMRD

SEQ ID NO: 1921 - protein, 8 aa, Conus generalis
GTPFLGAY

SEQ ID NO: 1922 - protein, 5 aa, Conus textile
LAPSE

SEQ ID NO: 1923 - protein, 5 aa, Conus textile
ESPTD

SEQ ID NO: 1924 - protein, 5 aa, Conus textile
ESPTD

SEQ ID NO: 1925 - protein, 5 aa, Conus textile
SHAHE

SEQ ID NO: 1926 - protein, 6 aa, Conus gloriamaris
DVISQN

SEQ ID NO: 1927 - protein, 6 aa, Conus gloriamaris
NVFSLD

SEQ ID NO: 1928 - protein, 6 aa, Conus gloriamaris
NWLTQN

SEQ ID NO: 1929 - protein, 5 aa, Conus gloriamaris
DSGNQ

SEQ ID NO: 1930 - protein, 9 aa, Conus gloriamaris
PVPLLSSGD

SEQ ID NO: 1931 - protein, 6 aa, Conus gloriamaris
DPIFQN

SEQ ID NO: 1932 - protein, 5 aa, Conus imperialis
NDGKV

SEQ ID NO: 1933 - protein, 5 aa, Conus judaeus
YYDSH

SEQ ID NO: 1934 - protein, 5 aa, Conus judaeus
NIHPH

SEQ ID NO: 1935 - protein, 6 aa, Conus textile
EMIRHT

SEQ ID NO: 1936 - protein, 6 aa, Conus textile
TFFFPN

SEQ ID NO: 1937 - protein, 5 aa, Conus lividus
RYHSD

SEQ ID NO: 1938 - protein, 5 aa, Conus litteratus
LAPSE

SEQ ID NO: 1939 - protein, 4 aa, Conus lividus
YTRP

SEQ ID NO: 1940 - protein, 5 aa, Conus lividus
DYPEE

SEQ ID NO: 1941 - protein, 6 aa, Conus lividus
EERDRN

SEQ ID NO: 1942 - protein, 6 aa, Conus lividus
SRWYNH

SEQ ID NO: 1943 - protein, 9 aa, Conus leopardus
ATGFFLDEE

SEQ ID NO: 1944 - protein, 5 aa, Conus litteratus
SSPSE

SEQ ID NO: 1945 - protein, 4 aa, Conus litteratus
DILP

SEQ ID NO: 1946 - protein, 5 aa, Conus litteratus
TYHYN

SEQ ID NO: 1947 - protein, 5 aa, Conus litteratus
GLVSE

SEQ ID NO: 1948 - protein, 6 aa, Conus litteratus
DPGNHN

SEQ ID NO: 1949 - protein, 6 aa, Conus litteratus
DPGNHN

SEQ ID NO: 1950 - protein, 5 aa, Conus litteratus
TSHSI

SEQ ID NO: 1951 - protein, 6 aa, Conus lividus
DVVEQN

SEQ ID NO: 1952 - protein, 5 aa, Conus lividus
TSKSP

SEQ ID NO: 1953 - protein, 5 aa, Conus lividus
TSKSP

SEQ ID NO: 1954 - protein, 5 aa, Conus lividus
TSKSP

SEQ ID NO: 1955 - protein, 5 aa, Conus lividus
TRHSP

SEQ ID NO: 1956 - protein, 5 aa, Conus lividus
TRHSP

SEQ ID NO: 1957 - protein, 5 aa, Conus lividus
RYHSH

SEQ ID NO: 1958 - protein, 5 aa, Conus lividus
GYHSH

SEQ ID NO: 1959 - protein, 5 aa, Conus miliaris
YVAST

SEQ ID NO: 1960 - protein, 5 aa, Conus miliaris
FYSYF

SEQ ID NO: 1961 - protein, 5 aa, Conus miliaris
GGHAH

SEQ ID NO: 1962 - protein, 5 aa, Conus miliaris
VRDTS

SEQ ID NO: 1963 - protein, 5 aa, Conus miliaris
FGPAA

SEQ ID NO: 1964 - protein, 5 aa, Conus miliaris
LSSYE

SEQ ID NO: 1965 - protein, 5 aa, Conus miliaris
DATTN

SEQ ID NO: 1966 - protein, 6 aa, Conus magus
DVFSLE

SEQ ID NO: 1967 - protein, 6 aa, Conus magus
GIKPGL

SEQ ID NO: 1968 - protein, 6 aa, Conus magus
GIRPGL

SEQ ID NO: 1969 - protein, 6 aa, Conus magus
GIHPGL

SEQ ID NO: 1970 - protein, 6 aa, Conus magus
GIKPGL

SEQ ID NO: 1971 - protein, 6 aa, Conus magus
GIKPGL

SEQ ID NO: 1972 - protein, 6 aa, Conus magus
SRLMYD

SEQ ID NO: 1973 - protein, 6 aa, Conus magus
HRTSYD

SEQ ID NO: 1974 - protein, 6 aa, Conus magus
RKTMYD

SEQ ID NO: 1975 - protein, 6 aa, Conus magus
RKTMYN

SEQ ID NO: 1976 - protein, 5 aa, Conus marmoreus
TSNWE

SEQ ID NO: 1977 - protein, 8 aa, Conus marmoreus
GFFKIGPP

SEQ ID NO: 1978 - protein, 8 aa, Conus marmoreus
GFPKPGPY

SEQ ID NO: 1979 - protein, 6 aa, Conus marmoreus
GILFPS

SEQ ID NO: 1980 - protein, 9 aa, Conus marmoreus
VLPFVGNGM

SEQ ID NO: 1981 - protein, 8 aa, Conus marmoreus
FAGYGHSS

SEQ ID NO: 1982 - protein, 5 aa, Conus magus
SQHPH

SEQ ID NO: 1983 - protein, 5 aa, Conus magus
NNDAE

SEQ ID NO: 1984 - protein, 5 aa, Conus magus
SQHPH

SEQ ID NO: 1985 - protein, 5 aa, Conus magus
DYSHE

SEQ ID NO: 1986 - protein, 6 aa, Conus miles
AEEGEE

SEQ ID NO: 1987 - protein, 5 aa, Conus miles
SQHPH

SEQ ID NO: 1988 - protein, 5 aa, Conus miles
TNTAL

SEQ ID NO: 1989 - protein, 5 aa, Conus miles
RSPYD

SEQ ID NO: 1990 - protein, 6 aa, Conus miles
EKFDND

SEQ ID NO: 1991 - protein, 5 aa, Conus miliaris
NGHSD

SEQ ID NO: 1992 - protein, 5 aa, Conus miliaris
YYRYF

SEQ ID NO: 1993 - protein, 5 aa, Conus miliaris
YYDYF

SEQ ID NO: 1994 - protein, 6 aa, Conus miliaris
DPSSDN

SEQ ID NO: 1995 - protein, 6 aa, Conus miliaris
DLFNSK

SEQ ID NO: 1996 - protein, 6 aa, Conus miliaris
DVVEQN

SEQ ID NO: 1997 - protein, 6 aa, Conus miliaris
DVVEQN

SEQ ID NO: 1998 - protein, 9 aa, Conus marmoreus
IVPIIGFIY

SEQ ID NO: 1999 - protein, 9 aa, Conus marmoreus
IVPILGFVY

SEQ ID NO: 2000 - protein, 6 aa, Conus nigropunctatus
GIKPGL

SEQ ID NO: 2001 - protein, 6 aa, Conus omaria
NWLTQN

SEQ ID NO: 2002 - protein, 6 aa, Conus omaria
NIFTQN

SEQ ID NO: 2003 - protein, 6 aa, Conus omaria
DPIRHT

SEQ ID NO: 2004 - protein, 6 aa, Conus omaria
LILYSD

SEQ ID NO: 2005 - protein, 8 aa, Conus omaria
GMIKIGPP

SEQ ID NO: 2006 - protein, 9 aa, Conus omaria
PGSLVGVIT

SEQ ID NO: 2007 - protein, 6 aa, Conus purpurascens
FPHQKD

SEQ ID NO: 2008 - protein, 6 aa, Conus purpurascens
FPHQKD

SEQ ID NO: 2009 - protein, 6 aa, Conus purpurascens
FPHQKD

SEQ ID NO: 2010 - protein, 6 aa, Conus purpurascens
GIKPGL

SEQ ID NO: 2011 - protein, 6 aa, Conus purpurascens
GIKPGL

SEQ ID NO: 2012 - protein, 6 aa, Conus purpurascens
FQHLDD

SEQ ID NO: 2013 - protein, 6 aa, Conus pennaceus
DMLRHT

SEQ ID NO: 2014 - protein, 6 aa, Conus pennaceus
EDEEKH

SEQ ID NO: 2015 - protein, 6 aa, Conus pennaceus
EDEEKT

SEQ ID NO: 2016 - protein, 5 aa, Conus pennaceus
ESPKR

SEQ ID NO: 2017 - protein, 6 aa, Conus pennaceus
NIITQN

SEQ ID NO: 2018 - protein, 9 aa, Conus pennaceus
PGALVGVIT

SEQ ID NO: 2019 - protein, 6 aa, Conus pennaceus
NFFFPN

SEQ ID NO: 2020 - protein, 6 aa, Conus pennaceus
DMVRHT

SEQ ID NO: 2021 - protein, 6 aa, Conus pennaceus
NIITQN

SEQ ID NO: 2022 - protein, 5 aa, Conus pennaceus
ESPKR

SEQ ID NO: 2023 - protein, 9 aa, Conus pennaceus
GIPFVNNGL

SEQ ID NO: 2024 - protein, 5 aa, Conus pennaceus
SYPHE

SEQ ID NO: 2025 - protein, 5 aa, Conus pennaceus
TTPSQ

SEQ ID NO: 2026 - protein, 9 aa, Conus pennaceus
GIPFANNGL

SEQ ID NO: 2027 - protein, 8 aa, Conus pennaceus
GMIKIGPP

SEQ ID NO: 2028 - protein, 5 aa, Conus pennaceus
TVNSE

SEQ ID NO: 2029 - protein, 6 aa, Conus pulicarius
GPGYEE

SEQ ID NO: 2030 - protein, 9 aa, Conus pulicarius
GIPYEHNWR

SEQ ID NO: 2031 - protein, 5 aa, Conus pulicarius
TLHRH

SEQ ID NO: 2032 - protein, 9 aa, Conus quercinus
VIPIIGNVF

SEQ ID NO: 2033 - protein, 8 aa, Conus quercinus
GFPKPEPH

SEQ ID NO: 2034 - protein, 3 aa, Conus quercinus
GFT

SEQ ID NO: 2035 - protein, 6 aa, Conus radiates
RVSSYN

SEQ ID NO: 2036 - protein, 5 aa, Conus radiates
EVDDT

SEQ ID NO: 2037 - protein, 6 aa, Conus striatus
SRIAYN

SEQ ID NO: 2038 - protein, 5 aa, Conus striatus
AEPVQ

SEQ ID NO: 2039 - protein, 5 aa, Conus striatus
SFTSQ

SEQ ID NO: 2040 - protein, 5 aa, Conus striatus
GVTGI

SEQ ID NO: 2041 - protein, 6 aa, Conus striatus
RKTMYD

SEQ ID NO: 2042 - protein, 6 aa, Conus striatus
GSTTRI

SEQ ID NO: 2043 - protein, 6 aa, Conus striatus
GIHPGL

SEQ ID NO: 2044 - protein, 6 aa, Conus striatus
SRIAYN

SEQ ID NO: 2045 - protein, 7 aa, Conus striatus
GPTVMKI

SEQ ID NO: 2046 - protein, 6 aa, Conus striatus
GSTTRI

SEQ ID NO: 2047 - protein, 5 aa, Conus striatus
GVTSI

SEQ ID NO: 2048 - protein, 5 aa, Conus striatus
GVTSI

SEQ ID NO: 2049 - protein, 6 aa, Conus striatus
RKTSYD

SEQ ID NO: 2050 - protein, 6 aa, Conus striatus
GIHPGL

SEQ ID NO: 2051 - protein, 6 aa, Conus stercusmuscarum
GIRPGL

SEQ ID NO: 2052 - protein, 7 aa, Conus spurius
FLGDDDI

SEQ ID NO: 2053 - protein, 6 aa, Conus striolatus
GIKPGL

SEQ ID NO: 2054 - protein, 6 aa, Conus striolatus
GINGGL

SEQ ID NO: 2055 - protein, 6 aa, Conus striolatus
VATTRI

SEQ ID NO: 2056 - protein, 6 aa, Conus tulipa
SPTSYN

SEQ ID NO: 2057 - protein, 3 aa, Conus tulipa
PPV

SEQ ID NO: 2058 - protein, 5 aa, Conus textile
TKDSE

SEQ ID NO: 2059 - protein, 3 aa, Conus textile
VVY

SEQ ID NO: 2060 - protein, 5 aa, Conus tessulatus
GLQRG

SEQ ID NO: 2061 - protein, 5 aa, Conus tessulatus
TSDPE

SEQ ID NO: 2062 - protein, 5 aa, Conus tessulatus
TSPEE

SEQ ID NO: 2063 - protein, 6 aa, Conus tessulatus
DDRNKE

SEQ ID NO: 2064 - protein, 6 aa, Conus tessulatus
EDRNKE

SEQ ID NO: 2065 - protein, 6 aa, Conus tessulatus
DDRNKE

SEQ ID NO: 2066 - protein, 6 aa, Conus tessulatus
EDLNKN

SEQ ID NO: 2067 - protein, 6 aa, Conus textile
DLIFQN

SEQ ID NO: 2068 - protein, 6 aa, Conus textile
TFFFPN

SEQ ID NO: 2069 - protein, 5 aa, Conus textile
NTGNQ

SEQ ID NO: 2070 - protein, 8 aa, Conus textile
GMIKIGPP

SEQ ID NO: 2071 - protein, 6 aa, Conus textile
NLLDQN

SEQ ID NO: 2072 - protein, 6 aa, Conus textile
NVLDQN

SEQ ID NO: 2073 - protein, 5 aa, Conus textile
LAPSE

SEQ ID NO: 2074 - protein, 5 aa, Conus textile
TDASQ

SEQ ID NO: 2075 - protein, 5 aa, Conus textile
SKDSE

SEQ ID NO: 2076 - protein, 5 aa, Conus textile
TKDSE

SEQ ID NO: 2077 - protein, 5 aa, Conus textile
SSGAP

SEQ ID NO: 2078 - protein, 6 aa, Conus textile
NLLDQN

SEQ ID NO: 2079 - protein, 6 aa, Conus textile
DFFFPT

SEQ ID NO: 2080 - protein, 6 aa, Conus textile
DMIRHT

SEQ ID NO: 2081 - protein, 5 aa, Conus textile
DSGIQ

SEQ ID NO: 2082 - protein, 9 aa, Conus textile
PAPFFGSRY

SEQ ID NO: 2083 - protein, 6 aa, Conus textile
DIFFPT

SEQ ID NO: 2084 - protein, 5 aa, Conus textile
NTGNQ

SEQ ID NO: 2085 - protein, 5 aa, Conus textile
DSGIQ

SEQ ID NO: 2086 - protein, 8 aa, Conus textile
GMIKIGPP

SEQ ID NO: 2087 - protein, 6 aa, Conus textile
NWLTQN

SEQ ID NO: 2088 - protein, 9 aa, Conus textile
PVPFLGSRY

SEQ ID NO: 2089 - protein, 6 aa, Conus textile
DVFSLD

SEQ ID NO: 2090 - protein, 5 aa, Conus textile
EVDSE

SEQ ID NO: 2091 - protein, 6 aa, Conus victoriae
LVLYTD

SEQ ID NO: 2092 - protein, 8 aa, Conus victoriae
GMIKVGPP

SEQ ID NO: 2093 - protein, 5 aa, Conus victoriae
DSGNQ

SEQ ID NO: 2094 - protein, 6 aa, Conus victoriae
DFLFPK

SEQ ID NO: 2095 - protein, 6 aa, Conus victoriae
DPFLQN

SEQ ID NO: 2096 - protein, 6 aa, Conus victoriae
TFFFPD

SEQ ID NO: 2097 - protein, 5 aa, Conus vexillum
RKHKE

SEQ ID NO: 2098 - protein, 5 aa, Conus virgo
TQSTP

SEQ ID NO: 2099 - protein, 8 aa, Conus virgo
GTPFLGAY

SEQ ID NO: 2100 - protein, 5 aa, Conus ventricosus
TQHSE

SEQ ID NO: 2101 - protein, 8 aa, Conus ventricosus
GFPKPGPY

SEQ ID NO: 2102 - protein, 8 aa, Conus ventricosus
GFPKIGEP

SEQ ID NO: 2103 - protein, 10 aa, Conus ventricosus
GILPFANSGV

SEQ ID NO: 2104 - protein, 6 aa, Conus ventricosus
FPVVAK

SEQ ID NO: 2105 - protein, 5 aa, Conus ventricosus
WRDTS

SEQ ID NO: 2106 - protein, 5 aa, Conus ventricosus
WLDSS

SEQ ID NO: 2107 - protein, 4 aa, Conus ventricosus
KNTP

SEQ ID NO: 2108 - protein, 4 aa, Conus ventricosus
KNTP

SEQ ID NO: 2109 - protein, 4 aa, Conus ventricosus
KNVP

SEQ ID NO: 2110 - protein, 7 aa, Conus ventricosus
EDRDKKT

SEQ ID NO: 2111 - protein, 5 aa, Conus ventricosus
TQHSD

SEQ ID NO: 2112 - protein, 6 aa, Conus ventricosus
EDRDKT

SEQ ID NO: 2113 - protein, 6 aa, Conus ventricosus
KEQNKT

SEQ ID NO: 2114 - protein, 6 aa, Conus ventricosus
KEQNKT

SEQ ID NO: 2115 - protein, 5 aa, Conus ventricosus
TTNSD

SEQ ID NO: 2116 - protein, 5 aa, Conus ventricosus
TSPAE

SEQ ID NO: 2117 - protein, 5 aa, Conus ventricosus
NFPSQ

SEQ ID NO: 2118 - protein, 7 aa, Conus ventricosus
GPWNNPP

SEQ ID NO: 2119 - protein, 7 aa, Conus ventricosus
GPWNNPP

SEQ ID NO: 2120 - protein, 8 aa, Conus ventricosus
GFPKIGGP

SEQ ID NO: 2121 - protein, 8 aa, Conus ventricosus
GFPKIGGP

SEQ ID NO: 2122 - protein, 5 aa, Conus vexillum
SQHPH

SEQ ID NO: 2123 - protein, 6 aa, Conus vexillum
DPNDHD

SEQ ID NO: 2124 - protein, 3 aa, Conus geographus
PPQ

SEQ ID NO: 2125 - protein, 5 aa, Conus arenatus
IRDSQ

SEQ ID NO: 2126 - protein, 5 aa, Conus aulicus
EHDSD

SEQ ID NO: 2127 - protein, 5 aa, Conus betulinus
ENDSQ

SEQ ID NO: 2128 - protein, 5 aa, Conus betulinus
ERHSN

SEQ ID NO: 2129 - protein, 5 aa, Conus betulinus
GRHSN

SEQ ID NO: 2130 - protein, 5 aa, Conus capitaneus
TRHLP

SEQ ID NO: 2131 - protein, 5 aa, Conus emaciatus
TPYLP

SEQ ID NO: 2132 - protein, 5 aa, Conus episcopatus
GQDSN

SEQ ID NO: 2133 - protein, 5 aa, Conus episcopatus
SMSGS

SEQ ID NO: 2134 - protein, 5 aa, Conus figulinus
TSGDG

SEQ ID NO: 2135 - protein, 5 aa, Conus figulinus
DYHAD

SEQ ID NO: 2136 - protein, 5 aa, Conus figulinus
SYHAD

SEQ ID NO: 2137 - protein, 5 aa, Conus figulinus
EYHAD

SEQ ID NO: 2138 - protein, 5 aa, Conus imperialis
GYDSD

SEQ ID NO: 2139 - protein, 5 aa, Conus imperialis
RRSYQ

SEQ ID NO: 2140 - protein, 5 aa, Conus imperialis
SSDSN

SEQ ID NO: 2141 - protein, 5 aa, Conus lynceus
DYHSE

SEQ ID NO: 2142 - protein, 5 aa, Conus magus
RNHAD

SEQ ID NO: 2143 - protein, 5 aa, Conus magus
GDDSD

SEQ ID NO: 2144 - protein, 5 aa, Conus magus
GYHAD

SEQ ID NO: 2145 - protein, 5 aa, Conus miles
SRYLP

SEQ ID NO: 2146 - protein, 5 aa, Conus radiates
GYHAD

SEQ ID NO: 2147 - protein, 5 aa, Conus radiates
GYHAD

SEQ ID NO: 2148 - protein, 5 aa, Conus radiates
DYHAD

SEQ ID NO: 2149 - protein, 5 aa, Conus radiates
GYHAD

SEQ ID NO: 2150 - protein, 5 aa, Conus radiates
GYHAD

SEQ ID NO: 2151 - protein, 5 aa, Conus radiates
GYHAD

SEQ ID NO: 2152 - protein, 5 aa, Conus radiates
GYHTH

SEQ ID NO: 2153 - protein, 5 aa, Conus radiates
SYHAD

SEQ ID NO: 2154 - protein, 5 aa, Conus radiates
RNHAD

SEQ ID NO: 2155 - protein, 5 aa, Conus radiates
RNHAD

SEQ ID NO: 2156 - protein, 5 aa, Conus radiates
TYHKD

SEQ ID NO: 2157 - protein, 5 aa, Conus radiates
RNHAD

SEQ ID NO: 2158 - protein, 5 aa, Conus radiates
EYHSD

SEQ ID NO: 2159 - protein, 5 aa, Conus radiates
EYHAD

SEQ ID NO: 2160 - protein, 5 aa, Conus radiates
SYHAD

SEQ ID NO: 2161 - protein, 5 aa, Conus radiates
KYHAD

SEQ ID NO: 2162 - protein, 5 aa, Conus radiates
SYHAD

SEQ ID NO: 2163 - protein, 5 aa, Conus radiates
SLHEE

SEQ ID NO: 2164 - protein, 5 aa, Conus regius
SAVVR

SEQ ID NO: 2165 - protein, 5 aa, Conus striatus
SYQAD

SEQ ID NO: 2166 - protein, 5 aa, Conus striatus
TRHRP

SEQ ID NO: 2167 - protein, 5 aa, Conus spurius
EENQQ

SEQ ID NO: 2168 - protein, 5 aa, Conus striolatus
ENDSQ

SEQ ID NO: 2169 - protein, 5 aa, Conus textile
SSSGS

SEQ ID NO: 2170 - protein, 5 aa, Conus virgo
TPYLP

SEQ ID NO: 2171 - protein, 5 aa, Conus vexillum
TPYLP

SEQ ID NO: 2172 - protein, 5 aa, Conus vexillum
TPYLP

SEQ ID NO: 2173 - protein, 5 aa, Cladosporium fulvum
TRAFD

SEQ ID NO: 2174 - protein, 5 aa, Aspergillus clavatus
FNNKD

SEQ ID NO: 2175 - protein, 5 aa, Aspergillus terreus
TGKND

SEQ ID NO: 2176 - protein, 5 aa, Neosartorya fischeri
LNKTG

SEQ ID NO: 2177 - protein, 6 aa, Botryotinia fuckeliana
HQTGET

SEQ ID NO: 2178 - protein, 6 aa, Botryotinia fuckeliana
MMQHDK

SEQ ID NO: 2179 - protein, 6 aa, Sclerotinia sclerotiorium
HLTGES

SEQ ID NO: 2180 - protein, 7 aa, Laccaria bicolor
DPDGREL

SEQ ID NO: 2181 - protein, 5 aa, Laccaria bicolor
SKDSD

SEQ ID NO: 2182 - protein, 5 aa, Laccaria bicolor
AADKD

SEQ ID NO: 2183 - protein, 5 aa, Laccaria bicolor
MSNSD

SEQ ID NO: 2184 - protein, 5 aa, Laccaria bicolor
QTDSD

SEQ ID NO: 2185 - protein, 5 aa, Laccaria bicolor
SFNSN

SEQ ID NO: 2186 - protein, 5 aa, Laccaria bicolor
SFDSN

SEQ ID NO: 2187 - protein, 5 aa, Chaetomium globosum
RVDTD

SEQ ID NO: 2188 - protein, 5 aa, Neurospora crassa
RVTSD

SEQ ID NO: 2189 - protein, 3 aa, Astyanax mexicanus
QGE

SEQ ID NO: 2190 - protein, 3 aa, Astyanax mexicanus
NGE

SEQ ID NO: 2191 - protein, 3 aa, Astyanax mexicanus
HGE

SEQ ID NO: 2192 - protein, 3 aa, Astyanax mexicanus
HGE

SEQ ID NO: 2193 - protein, 3 aa, Astyanax mexicanus
HGE

SEQ ID NO: 2194 - protein, 3 aa, Paracentrotus lividus
HGE

SEQ ID NO: 2195 - protein, 3 aa, Paracentrotus lividus
DGE

SEQ ID NO: 2196 - protein, 3 aa, Sparus aurata
HGE

SEQ ID NO: 2197 - protein, 3 aa, Sparus aurata
AGC

SEQ ID NO: 2198 - protein, 3 aa, Homo sapiens
GGC

SEQ ID NO: 2199 - protein, 3 aa, Homo sapiens
EGV

SEQ ID NO: 2200 - protein, 3 aa, Homo sapiens
EGL

SEQ ID NO: 2201 - protein, 3 aa, Homo sapiens
EGE

SEQ ID NO: 2202 - protein, 3 aa, Paralabidochromis chilotes
HGE

SEQ ID NO: 2203 - protein, 3 aa, Danio rerio
AGC

SEQ ID NO: 2204 - protein, 3 aa, Sus scrofa
EGE

SEQ ID NO: 2205 - protein, 3 aa, Sus scrofa
EGE

SEQ ID NO: 2206 - protein, 3 aa, Anas platyrhynchos
HGD

SEQ ID NO: 2207 - protein, 3 aa, Anas platyrhynchos
HGD

SEQ ID NO: 2208 - protein, 3 aa, Oryzias latipes
AGC

SEQ ID NO: 2209 - protein, 3 aa, Bos Taurus
HGE

SEQ ID NO: 2210 - protein, 3 aa, Capra hircus
HGD

SEQ ID NO: 2211 - protein, 3 aa, Bos Taurus
HGE

SEQ ID NO: 2212 - protein, 3 aa, Oryctolagus cuniculus
EGE

SEQ ID NO: 2213 - protein, 3 aa, Sus scrofa
HGD

SEQ ID NO: 2214 - protein, 3 aa, Nematostella vectensis
SGE

SEQ ID NO: 2215 - protein, 3 aa, Nematostella vectensis
TGV

SEQ ID NO: 2216 - protein, 3 aa, Nematostella vectensis
EGE

SEQ ID NO: 2217 - protein, 3 aa, Danio rerio
EGM

SEQ ID NO: 2218 - protein, 3 aa, Homo sapiens
EGE

SEQ ID NO: 2219 - protein, 3 aa, Homo sapiens
DGE

SEQ ID NO: 2220 - protein, 3 aa, Sus scrofa
EGE

SEQ ID NO: 2221 - protein, 3 aa, Ovis aries
HGD

SEQ ID NO: 2222 - protein, 3 aa, Xenopus tropicalis
HGD

SEQ ID NO: 2223 - protein, 3 aa, Xenopus tropicalis
AGC

SEQ ID NO: 2224 - protein, 3 aa, Papio anubis
HGD

SEQ ID NO: 2225 - protein, 3 aa, Papio anubis
EGL

SEQ ID NO: 2226 - protein, 3 aa, Ovis aries
GGC

SEQ ID NO: 2227 - protein, 3 aa, Callithrix jacchus
EGL

SEQ ID NO: 2228 - protein, 3 aa, Sistrurus catenatus edwardsii
GGC

SEQ ID NO: 2229 - protein, 3 aa, Sistrurus catenatus edwardsii
GGC

SEQ ID NO: 2230 - protein, 3 aa, Culex quinquefasciatus
QGD

SEQ ID NO: 2231 - protein, 3 aa, Homo sapiens
EGE

SEQ ID NO: 2232 - protein, 3 aa, Callicebus moloch
EGL

SEQ ID NO: 2233 - protein, 3 aa, Ambystoma mexicanum
HGD

SEQ ID NO: 2234 - protein, 3 aa, Ochotona curzoniae
AGC

SEQ ID NO: 2235 - protein, 3 aa, Ochotona curzoniae
AGC

SEQ ID NO: 2236 - protein, 3 aa, Rhinolophus ferrumequinum
HGD

SEQ ID NO: 2237 - protein, 3 aa, Rhinolophus ferrumequinum
EGL

SEQ ID NO: 2238 - protein, 3 aa, Ovis aries
DGE

SEQ ID NO: 2239 - protein, 3 aa, Capra hircus
DGE

SEQ ID NO: 2240 - protein, 3 aa, Mus musculus
DGE

SEQ ID NO: 2241 - protein, 3 aa, Homo sapiens
EGE

SEQ ID NO: 2242 - protein, 3 aa, Danio rerio
QGE

SEQ ID NO: 2243 - protein, 3 aa, Danio rerio
EGM

SEQ ID NO: 2244 - protein, 3 aa, Strongylocentrotus purpuratus
RGE

SEQ ID NO: 2245 - protein, 3 aa, Drosophila erecta
HGK

SEQ ID NO: 2246 - protein, 3 aa, Sorex araneus
HGD

SEQ ID NO: 2247 - protein, 3 aa, Sorex araneus
EGL

SEQ ID NO: 2248 - protein, 3 aa, Saccostrea kegaki
DGS

SEQ ID NO: 2249 - protein, 3 aa, Homo sapiens
DGE

SEQ ID NO: 2250 - protein, 3 aa, Drosophilia grimshawi
HGK

SEQ ID NO: 2251 - protein, 3 aa, Drosophilia mojavensis
HGK

SEQ ID NO: 2252 - protein, 3 aa, Drosophilia virilis
HGK

SEQ ID NO: 2253 - protein, 3 aa, Drosophilia willistoni
HGK

SEQ ID NO: 2254 - protein, 3 aa, Drosophilia yakuba
HGK

SEQ ID NO: 2255 - protein, 3 aa, Drosophilia simulans
HGK

SEQ ID NO: 2256 - protein, 3 aa, Sus scrofa
GGC

SEQ ID NO: 2257 - protein, 3 aa, Xenopus tropicalis
EGL

SEQ ID NO: 2258 - protein, 3 aa, Homo sapiens
GGC

SEQ ID NO: 2259 - protein, 3 aa, Rattus norvegicus
AGC

SEQ ID NO: 2260 - protein, 3 aa, Otolemur garnettii
HGD

SEQ ID NO: 2261 - protein, 3 aa, Otolemur garnettii
EGL

SEQ ID NO: 2262 - protein, 3 aa, Salmo salar
HGE

SEQ ID NO: 2263 - protein, 3 aa, Sus scrofa
TGC

SEQ ID NO: 2264 - protein, 3 aa, Branchiostoma floridae
SGE

SEQ ID NO: 2265 - protein, 3 aa, Branchiostoma floridae
SGE

SEQ ID NO: 2266 - protein, 3 aa, Branchiostoma floridae
AGA

SEQ ID NO: 2267 - protein, 3 aa, Branchiostoma floridae
HGE

SEQ ID NO: 2268 - protein, 3 aa, Branchiostoma floridae
AGD

SEQ ID NO: 2269 - protein, 3 aa, Branchiostoma floridae
AGA

SEQ ID NO: 2270 - protein, 3 aa, Stylophora pistillata
KGE

SEQ ID NO: 2271 - protein, 3 aa, Acropora sp. DZ-2008
KGE

SEQ ID NO: 2272 - protein, 3 aa, Pseudocowpox virus
GGC

SEQ ID NO: 2273 - protein, 3 aa, Pseudocowpox virus
GGC

SEQ ID NO: 2274 - protein, 3 aa, Labidochromis caeruleus
DGA

SEQ ID NO: 2275 - protein, 3 aa, Oryctolagus cuniculus
EGL

SEQ ID NO: 2276 - protein, 3 aa, Ixodes scapularis
HGV

SEQ ID NO: 2277 - protein, 3 aa, Xenopus laevis
HGD

SEQ ID NO: 2278 - protein, 3 aa, Xenopus laevis
EGV

SEQ ID NO: 2279 - protein, 3 aa, Xenopus laevis
HGE

SEQ ID NO: 2280 - protein, 3 aa, Danio rerio
AGC

SEQ ID NO: 2281 - protein, 3 aa, Salmo salar
HGE

SEQ ID NO: 2282 - protein, 3 aa, Gadus morhua
HGE

SEQ ID NO: 2283 - protein, 3 aa, Bombyx mori
QGD

SEQ ID NO: 2284 - protein, 3 aa, Mus musculus
DGE

SEQ ID NO: 2285 - protein, 3 aa, Salmo salar
HGE

SEQ ID NO: 2286 - protein, 3 aa, Bitis arietans
GGC

SEQ ID NO: 2287 - protein, 3 aa, Agkistrodon piscivorus piscivorus
GGC

SEQ ID NO: 2288 - protein, 3 aa, Crotalus atrox
GGC

SEQ ID NO: 2289 - protein, 3 aa, Agkistrodon piscivorus piscivorus
GGC

SEQ ID NO: 2290 - protein, 3 aa, Vipera ammodytes ammodytes
GGC

SEQ ID NO: 2291 - protein, 3 aa, Protobothrops flavoviridis
GGC

SEQ ID NO: 2292 - protein, 3 aa, Protobothrops flavoviridis
GGC

SEQ ID NO: 2293 - protein, 3 aa, Vipera ammodytes ammodytes
SGC

SEQ ID NO: 2294 - protein, 3 aa, Daboia russelli russelli
SGC

SEQ ID NO: 2295 - protein, 3 aa, Osmerus mordax
AGC

SEQ ID NO: 2296 - protein, 3 aa, Anoplopoma fimbria
SGC

SEQ ID NO: 2297 - protein, 3 aa, Dasypus novemcinctus
EGL

SEQ ID NO: 2298 - protein, 3 aa, Myotis ricketti
HGE

SEQ ID NO: 2299 - protein, 3 aa, Danio rerio
HGE

SEQ ID NO: 2300 - protein, 3 aa, Danio rerio
HGE

SEQ ID NO: 2301 - protein, 3 aa, Danio rerio
QGE

SEQ ID NO: 2302 - protein, 3 aa, Dama dama
HGE

SEQ ID NO: 2303 - protein, 3 aa, Danio rerio
DGV

SEQ ID NO: 2304 - protein, 3 aa, Xenopus laevis
AGC

SEQ ID NO: 2305 - protein, 3 aa, Xenopus laevis
AGC

SEQ ID NO: 2306 - protein, 3 aa, Oryctolagus cuniculus
HGE

SEQ ID NO: 2307 - protein, 3 aa, Oryctolagus cuniculus
HGD

SEQ ID NO: 2308 - protein, 3 aa, Danio rerio
HGE

SEQ ID NO: 2309 - protein, 3 aa, Danio rerio
HGE

SEQ ID NO: 2310 - protein, 3 aa, Danio rerio
AGC

SEQ ID NO: 2311 - protein, 3 aa, Danio rerio
AGC

SEQ ID NO: 2312 - protein, 3 aa, Xenopus laevis
HGD

SEQ ID NO: 2313 - protein, 3 aa, Halocynthia roretzi
NGE

SEQ ID NO: 2314 - protein, 3 aa, Ovis aries
GGC

SEQ ID NO: 2315 - protein, 3 aa, Rattus norvegicus
AGC

SEQ ID NO: 2316 - protein, 3 aa, Danio rerio
HGE

SEQ ID NO: 2317 - protein, 3 aa, Gallus gallus
EGV

SEQ ID NO: 2318 - protein, 3 aa, Branchiostoma floridae
HGE

SEQ ID NO: 2319 - protein, 3 aa, Crassostrea gigas
DGS

SEQ ID NO: 2320 - protein, 3 aa, Drosophilia melanogaster
HGK

SEQ ID NO: 2321 - protein, 3 aa, Homo sapiens
HGE

SEQ ID NO: 2322 - protein, 3 aa, Homo sapiens
HGD

SEQ ID NO: 2323 - protein, 3 aa, Bos Taurus
GGC

SEQ ID NO: 2324 - protein, 3 aa, Bos Taurus
GGC

SEQ ID NO: 2325 - protein, 3 aa, Bos Taurus
GGC

SEQ ID NO: 2326 - protein, 3 aa, Bos Taurus
GGC

SEQ ID NO: 2327 - protein, 3 aa, Bos Taurus
GGC

SEQ ID NO: 2328 - protein, 3 aa, Bos Taurus
GGC

SEQ ID NO: 2329 - protein, 3 aa, Bos Taurus
GGC

SEQ ID NO: 2330 - protein, 3 aa, Bos Taurus
GGC

SEQ ID NO: 2331 - protein, 3 aa, Bos Taurus
GGC

SEQ ID NO: 2332 - protein, 3 aa, Bos Taurus
GGC

SEQ ID NO: 2333 - protein, 3 aa, Bos Taurus
GGC

SEQ ID NO: 2334 - protein, 3 aa, Bos Taurus
GGC

SEQ ID NO: 2335 - protein, 3 aa, Rattus norvegicus
AGC

SEQ ID NO: 2336 - protein, 3 aa, Rattus norvegicus
AGC

SEQ ID NO: 2337 - protein, 3 aa, Rattus norvegicus
AGC

SEQ ID NO: 2338 - protein, 3 aa, Rattus norvegicus
AGC

SEQ ID NO: 2339 - protein, 3 aa, Homo sapiens
EGE

SEQ ID NO: 2340 - protein, 3 aa, Mus musculus
DGE

SEQ ID NO: 2341 - protein, 3 aa, Mus musculus
HGE

SEQ ID NO: 2342 - protein, 3 aa, Mus musculus
HGD

SEQ ID NO: 2343 - protein, 3 aa, Homo sapiens
DGE

SEQ ID NO: 2344 - protein, 3 aa, Homo sapiens
DGE

SEQ ID NO: 2345 - protein, 3 aa, Mus musculus
EGE

SEQ ID NO: 2346 - protein, 3 aa, Xenopus laevis
HGE

SEQ ID NO: 2347 - protein, 3 aa, Cavia porcellus
GGC

SEQ ID NO: 2348 - protein, 3 aa, Xenopus laevis
HGE

SEQ ID NO: 2349 - protein, 3 aa, Xenopus laevis
HGD

SEQ ID NO: 2350 - protein, 3 aa, Danio rerio
HGE

SEQ ID NO: 2351 - protein, 3 aa, Homo sapiens
EGL

SEQ ID NO: 2352 - protein, 3 aa, Mus musculus
EGL

SEQ ID NO: 2353 - protein, 3 aa, Mus musculus
EGV

SEQ ID NO: 2354 - protein, 3 aa, Mus musculus
EGV

SEQ ID NO: 2355 - protein, 3 aa, Mus musculus
EGV

SEQ ID NO: 2356 - protein, 3 aa, Strongylocentrotus purpuratus
QGE

SEQ ID NO: 2357 - protein, 3 aa, Strongylocentrotus purpuratus
DGE

SEQ ID NO: 2358 - protein, 3 aa, Rattus norvegicus
HGE

SEQ ID NO: 2359 - protein, 3 aa, Mus musculus
DGE

SEQ ID NO: 2360 - protein, 3 aa, Sus scrofa
GGC

SEQ ID NO: 2361 - protein, 3 aa, Homo sapiens
TGC

SEQ ID NO: 2362 - protein, 3 aa, Homo sapiens
TGC

SEQ ID NO: 2363 - protein, 3 aa, Homo sapiens
TGC

SEQ ID NO: 2364 - protein, 3 aa, Mus musculus
SGC

SEQ ID NO: 2365 - protein, 3 aa, Ovis aries
GGC

SEQ ID NO: 2366 - protein, 3 aa, Bos taurus
EGV

SEQ ID NO: 2367 - protein, 3 aa, Protobothrops flavoviridis
GGC

SEQ ID NO: 2368 - protein, 3 aa, Protobothrops flavoviridis
GGC

SEQ ID NO: 2369 - protein, 3 aa, Protobothrops flavoviridis
GGC

SEQ ID NO: 2370 - protein, 3 aa, Daboia russelli russelli
SGC

SEQ ID NO: 2371 - protein, 3 aa, Protobothrops flavoviridis
GGC

SEQ ID NO: 2372 - protein, 3 aa, Vipera ammodytes ammodytes
SGC

SEQ ID NO: 2373 - protein, 3 aa, Gallus gallus
AGC

SEQ ID NO: 2374 - protein, 3 aa, Coturnix coturnix japonica
AGC

SEQ ID NO: 2375 - protein, 3 aa, Coturnix coturnix japonica
AGC

SEQ ID NO: 2376 - protein, 3 aa, Coturnix coturnix japonica
AGC

SEQ ID NO: 2377 - protein, 3 aa, Coturnix coturnix japonica
AGC

SEQ ID NO: 2378 - protein, 3 aa, Macrovipera lebetina
SGC

SEQ ID NO: 2379 - protein, 3 aa, Bitis gabonica
GGC

SEQ ID NO: 2380 - protein, 3 aa, Viper aspis aspis
SGC

SEQ ID NO: 2381 - protein, 3 aa, Danio rerio
EGV

SEQ ID NO: 2382 - protein, 3 aa, Gallus gallus
DGE

SEQ ID NO: 2383 - protein, 3 aa, Drosophilia simulans
HGK

SEQ ID NO: 2384 - protein, 3 aa, Drosophilia virilis
HGK

SEQ ID NO: 2385 - protein, 3 aa, Mus musculus
AGC

SEQ ID NO: 2386 - protein, 3 aa, Mus musculus
AGC

SEQ ID NO: 2387 - protein, 3 aa, Mus musculus
AGC

SEQ ID NO: 2388 - protein, 3 aa, Mus musculus
AGC

SEQ ID NO: 2389 - protein, 3 aa, Rattus norvegicus
DGE

SEQ ID NO: 2390 - protein, 3 aa, Rattus norvegicus
HGD

SEQ ID NO: 2391 - protein, 3 aa, Xenopus tropicalis
AGC

SEQ ID NO: 2392 - protein, 3 aa, Nematostella vectensis
TGV

SEQ ID NO: 2393 - protein, 3 aa, Danio rerio
AGC

SEQ ID NO: 2394 - protein, 3 aa, Aedes aegypti
HGD

SEQ ID NO: 2395 - protein, 3 aa, Pantholops hodgsonii
GGC

SEQ ID NO: 2396 - protein, 3 aa, Danio rerio
AGC

SEQ ID NO: 2397 - protein, 3 aa, Danio rerio
AGC

SEQ ID NO: 2398 - protein, 3 aa, Saccoglossus kowalevskii
NGE

SEQ ID NO: 2399 - protein, 3 aa, Saccoglossus kowalevskii
HGE

SEQ ID NO: 2400 - protein, 3 aa, Drosophila yakuba
HGK

SEQ ID NO: 2401 - protein, 3 aa, Drosophila teissieri
HGK

SEQ ID NO: 2402 - protein, 3 aa, Drosophila orena
HGK

SEQ ID NO: 2403 - protein, 3 aa, Junonia coenia
QGD

SEQ ID NO: 2404 - protein, 3 aa, Schistocerca Americana
HGD

SEQ ID NO: 2405 - protein, 3 aa, Nematostella vectensis
SGE

SEQ ID NO: 2406 - protein, 3 aa, Dama dama
HGD

SEQ ID NO: 2407 - protein, 3 aa, Bos taurus
HGD

SEQ ID NO: 2408 - protein, 3 aa, Eleutherodactylus coqui
HGD

SEQ ID NO: 2409 - protein, 3 aa, Homo sapiens
EGL

SEQ ID NO: 2410 - protein, 3 aa, Didelphis albiventris
QGD

SEQ ID NO: 2411 - protein, 3 aa, Platynereis dumerilii
NGE

SEQ ID NO: 2412 - protein, 3 aa, Nematostella vectensis
EGE

SEQ ID NO: 2413 - protein, 3 aa, Protobothrops mucrosquamatus
GGC

SEQ ID NO: 2414 - protein, 3 aa, Anguilla japonica
GGC

SEQ ID NO: 2415 - protein, 3 aa, Amphiura filiformis
HGE

SEQ ID NO: 2416 - protein, 3 aa, Equus caballus
EGL

SEQ ID NO: 2417 - protein, 3 aa, Mus musculus
HGD

SEQ ID NO: 2418 - protein, 3 aa, Mus musculus
DGE

SEQ ID NO: 2419 - protein, 3 aa, Mus musculus
HGE

SEQ ID NO: 2420 - protein, 3 aa, Mus musculus
DGE

SEQ ID NO: 2421 - protein, 3 aa, Mus musculus
DGE

SEQ ID NO: 2422 - protein, 3 aa, Mus musculus
HGE

SEQ ID NO: 2423 - protein, 3 aa, Ciona intestinalis
AGE

SEQ ID NO: 2424 - protein, 3 aa, Homo sapiens
DGE

SEQ ID NO: 2425 - protein, 3 aa, Bos taurus
HGD

SEQ ID NO: 2426 - protein, 3 aa, Macaca fascicularis
DGE

SEQ ID NO: 2427 - protein, 3 aa, Tetraodon nigroviridis
AGC

SEQ ID NO: 2428 - protein, 3 aa, Tetraodon nigroviridis
HGD

SEQ ID NO: 2429 - protein, 3 aa, Tetraodon nigroviridis
DGE

SEQ ID NO: 2430 - protein, 3 aa, Tetraodon nigroviridis
SGC

SEQ ID NO: 2431 - protein, 3 aa, Tetraodon nigroviridis
EGV

SEQ ID NO: 2432 - protein, 3 aa, Tetraodon nigroviridis
GGC

SEQ ID NO: 2433 - protein, 3 aa, Tetraodon nigroviridis
HGE

SEQ ID NO: 2434 - protein, 3 aa, Orf virus
GGC

SEQ ID NO: 2435 - protein, 3 aa, Homo sapiens
DGE

SEQ ID NO: 2436 - protein, 3 aa, Homo sapiens
HGD

SEQ ID NO: 2437 - protein, 3 aa, Homo sapiens
TGC

SEQ ID NO: 2438 - protein, 3 aa, Gallus gallus
AGC

SEQ ID NO: 2439 - protein, 3 aa, Rattus norvegicus
AGC

SEQ ID NO: 2440 - protein, 3 aa, Mus musculus
SGC

SEQ ID NO: 2441 - protein, 3 aa, Xenopus laevis
HGE

SEQ ID NO: 2442 - protein, 3 aa, Amphiura filiformis
SGE

SEQ ID NO: 2443 - protein, 3 aa, Homo sapiens
GGC

SEQ ID NO: 2444 - protein, 3 aa, Bos taurus
HGD

SEQ ID NO: 2445 - protein, 3 aa, Danio rerio
AGC

SEQ ID NO: 2446 - protein, 3 aa, Danio rerio
HGE

SEQ ID NO: 2447 - protein, 3 aa, Nematostella vectensis
EGE

SEQ ID NO: 2448 - protein, 3 aa, Rattus norvegicus
SGC

SEQ ID NO: 2449 - protein, 3 aa, Rattus norvegicus
AGC

SEQ ID NO: 2450 - protein, 3 aa, Xenopus tropicalis
YGE

SEQ ID NO: 2451 - protein, 3 aa, Xenopus laevis
EGL

SEQ ID NO: 2452 - protein, 3 aa, Rattus norvegicus
HGD

SEQ ID NO: 2453 - protein, 3 aa, Trachemys scripta
HGE

SEQ ID NO: 2454 - protein, 3 aa, Oncohynchus mykiss
AGC

SEQ ID NO: 2455 - protein, 3 aa, Oncorhynchus mykiss
AGC

SEQ ID NO: 2456 - protein, 3 aa, Rattus norvegicus
EGV

SEQ ID NO: 2457 - protein, 3 aa, Petromyzon marinus
QGE

SEQ ID NO: 2458 - protein, 3 aa, Petromyzon marinus
HGE

SEQ ID NO: 2459 - protein, 3 aa, Petromyzon marinus
QGE

SEQ ID NO: 2460 - protein, 3 aa, Bothrops erythromelas
GGC

SEQ ID NO: 2461 - protein, 3 aa, Homo sapiens
EGV

SEQ ID NO: 2462 - protein, 3 aa, Xenopus tropicalis
EGE

SEQ ID NO: 2463 - protein, 3 aa, Xenopus laevis
HGD

SEQ ID NO: 2464 - protein, 3 aa, Bovine popular stomatitis virus
GGC

SEQ ID NO: 2465 - protein, 3 aa, Equus caballus
HGD

SEQ ID NO: 2466 - protein, 3 aa, Bovine popular stomatitis virus
GGC

SEQ ID NO: 2467 - protein, 3 aa, Homo sapiens
GGC

SEQ ID NO: 2468 - protein, 3 aa, Gallus gallus
HGE

SEQ ID NO: 2469 - protein, 3 aa, Mus musculus
AGC

SEQ ID NO: 2470 - protein, 3 aa, Paralichthys olivaceus
HGE

SEQ ID NO: 2471 - protein, 3 aa, Homo sapiens
EGL

SEQ ID NO: 2472 - protein, 3 aa, Athalia rosae
HGD

SEQ ID NO: 2473 - protein, 3 aa, Orv virus strain D1701
GGC

SEQ ID NO: 2474 - protein, 3 aa, Tanganicodus irsacae
HGE

SEQ ID NO: 2475 - protein, 3 aa, Ophthalmotilapia nasuta
HGE

SEQ ID NO: 2476 - protein, 3 aa, Haplotaxodon microlepis
HGE

SEQ ID NO: 2477 - protein, 3 aa, Gnathochromis permaxillaris
HGE

SEQ ID NO: 2478 - protein, 3 aa, Anopheles gambiae
QGD

SEQ ID NO: 2479 - protein, 3 aa, Danio rerio
DGE

SEQ ID NO: 2480 - protein, 3 aa, Homo sapiens
EGL

SEQ ID NO: 2481 - protein, 3 aa, Tetraodon nigroviridis
QGE

SEQ ID NO: 2482 - protein, 3 aa, Takifugu rubripes
QGE

SEQ ID NO: 2483 - protein, 3 aa, Rattus norvegicus
HGD

SEQ ID NO: 2484 - protein, 3 aa, Oryctolagus cuniculus
GGC

SEQ ID NO: 2485 - protein, 3 aa, Parasteatoda tepidariorum
HGD

SEQ ID NO: 2486 - protein, 3 aa, Ilyanassa obsolete
QGD

SEQ ID NO: 2487 - protein, 3 aa, Mus musculus
DGE

SEQ ID NO: 2488 - protein, 3 aa, Mus musculus
EGL

SEQ ID NO: 2489 - protein, 3 aa, Mus musculus
DGE

SEQ ID NO: 2490 - protein, 3 aa, Mustela vison
GGC

SEQ ID NO: 2491 - protein, 3 aa, Ovis aries
TGC

SEQ ID NO: 2492 - protein, 3 aa, Stichopus japonicas
QGE

SEQ ID NO: 2493 - protein, 3 aa, Boulengerochromis microlepis
HGE

SEQ ID NO: 2494 - protein, 3 aa, Talapia rendalli
HGE

SEQ ID NO: 2495 - protein, 3 aa, Tropheus duboisi
HGE

SEQ ID NO: 2496 - protein, 3 aa, Steatocranus casuarius
HGE

SEQ ID NO: 2497 - protein, 3 aa, Oreochromis niloticus
HGE

SEQ ID NO: 2498 - protein, 3 aa, Labidochromis caeruleus
HGE

SEQ ID NO: 2499 - protein, 3 aa, Julidochromis transcriptus
HGE

SEQ ID NO: 2500 - protein, 3 aa, Pundamilia nyererei
HGE

SEQ ID NO: 2501 - protein, 3 aa, Haplochromis burtoni
HGE

SEQ ID NO: 2502 - protein, 3 aa, Cyprichromis leptosome
HGE

SEQ ID NO: 2503 - protein, 3 aa, Ctenochromis horei
HGE

SEQ ID NO: 2504 - protein, 3 aa, Astatoreochromis alluaudi
HGE

SEQ ID NO: 2505 - protein, 3 aa, Suncus murinus
HGD

SEQ ID NO: 2506 - protein, 3 aa, Patella vulgata
RGE

SEQ ID NO: 2507 - protein, 3 aa, Acropora millepora
KGE

SEQ ID NO: 2508 - protein, 3 aa, Hemicentrotus pulcherrimus
QGE

SEQ ID NO: 2509 - protein, 3 aa, Equus caballus
GGC

SEQ ID NO: 2510 - protein, 3 aa, Sus scrofa
GGC

SEQ ID NO: 2511 - protein, 3 aa, Sus scrofa
GGC

SEQ ID NO: 2512 - protein, 3 aa, Archaster typicus
QGE

SEQ ID NO: 2513 - protein, 3 aa, Gallus gallus
LGE

SEQ ID NO: 2514 - protein, 3 aa, Gallus gallus
HGE

SEQ ID NO: 2515 - protein, 3 aa, Gallus gallus
HGD

SEQ ID NO: 2516 - protein, 3 aa, Bothrops jararaca
GGC

SEQ ID NO: 2517 - protein, 3 aa, Bothrops insularis
GGC

SEQ ID NO: 2518 - protein, 3 aa, Lampetra japonica
HGE

SEQ ID NO: 2519 - protein, 3 aa, Lampetra japonica
QGE

SEQ ID NO: 2520 - protein, 3 aa, Xenopus tropicalis
HGD

SEQ ID NO: 2521 - protein, 3 aa, Xenopus tropicalis
HGE

SEQ ID NO: 2522 - protein, 3 aa, Gallus gallus
EGE

SEQ ID NO: 2523 - protein, 3 aa, Xenopus laevis
HGD

SEQ ID NO: 2524 - protein, 3 aa, Felis catus
GGC

SEQ ID NO: 2525 - protein, 3 aa, Macaca fascicularis
GGC

SEQ ID NO: 2526 - protein, 3 aa, Schistocerca gregaria
HGD

SEQ ID NO: 2527 - protein, 3 aa, Gallus Gallus
LGE

SEQ ID NO: 2528 - protein, 3 aa, Mesocricetus auratus
GGC

SEQ ID NO: 2529 - protein, 3 aa, Macaca mulatta
GGC

SEQ ID NO: 2530 - protein, 3 aa, Chlorocebus aethiops
EGV

SEQ ID NO: 2531 - protein, 3 aa, Macaca fascicularis
EGV

SEQ ID NO: 2532 - protein, 3 aa, Xenopus laevis
EGV

SEQ ID NO: 2533 - protein, 3 aa, Mesocricetus auratus
GGC

SEQ ID NO: 2534 - protein, 3 aa, Callithrix jacchus
GGC

SEQ ID NO: 2535 - protein, 3 aa, Equus caballus
GGC

SEQ ID NO: 2536 - protein, 3 aa, Gallus gallus
EGE

SEQ ID NO: 2537 - protein, 3 aa, Canis familiaris
GGC

SEQ ID NO: 2538 - protein, 3 aa, Canis familiaris
GGC

SEQ ID NO: 2539 - protein, 3 aa, Canis familiaris
GGC

SEQ ID NO: 2540 - protein, 3 aa, Ovis aries
GGC

SEQ ID NO: 2541 - protein, 3 aa, Canis familiaris
HGD

SEQ ID NO: 2542 - protein, 3 aa, Danio rerio
EGE

SEQ ID NO: 2543 - protein, 3 aa, Spalax ehrenbergi
GGC

SEQ ID NO: 2544 - protein, 3 aa, Branchiostoma belcheri
HGE

SEQ ID NO: 2545 - protein, 3 aa, Ptychodera flava
DGE

SEQ ID NO: 2546 - protein, 3 aa, Danio rerio
EGL

SEQ ID NO: 2547 - protein, 3 aa, Gallus gallus
EGL

SEQ ID NO: 2548 - protein, 3 aa, Xenopus laevis
EGV

SEQ ID NO: 2549 - protein, 3 aa, Bos taurus
TGC

SEQ ID NO: 2550 - protein, 3 aa, Lytechinus variegatus
HGE

SEQ ID NO: 2551 - protein, 3 aa, Strongylocentrotus purpuratus
RGE

SEQ ID NO: 2552 - protein, 3 aa, Tripneustes gratilla
HGE

SEQ ID NO: 2553 - protein, 3 aa, Xenopus laevis
EGE

SEQ ID NO: 2554 - protein, 3 aa, Xenopus laevis
HGE

SEQ ID NO: 2555 - protein, 3 aa, Orf virus
GGC

SEQ ID NO: 2556 - protein, 6 aa, Gymnema sylvestre
IPYYLD

SEQ ID NO: 2557 - protein, 8 aa, Acrocinus longimanus
QPDGSQGN

SEQ ID NO: 2558 - protein, 8 aa, Acrocinus longimanus
QPDGSQGN

SEQ ID NO: 2559 - protein, 8 aa, Acrocinus longimanus
QPNGSQGN

SEQ ID NO: 2560 - protein, 5 aa, Pimpla hypochondriaca
SPTEE

SEQ ID NO: 2561 - protein, 6 aa, Pimpla hypochondriaca
QIGSAT

SEQ ID NO: 2562 - protein, 5 aa, Lysiphlebus testaceipes
QTDDD

SEQ ID NO: 2563 - protein, 8 aa, Bemisia tabaci
KPDGSIGN

SEQ ID NO: 2564 - protein, 8 aa, Bemisia tabaci
KGDGSMGN

SEQ ID NO: 2565 - protein, 8 aa, Bemisia tabaci
QSDGSIGN

SEQ ID NO: 2566 - protein, 8 aa, Bemisia tabaci
QADGSMGN

SEQ ID NO: 2567 - protein, 8 aa, Bradysia hygida
HESDPGPG

SEQ ID NO: 2568 - protein, 5 aa, Solanum lycopersicum
SSNSD

SEQ ID NO: 2569 - protein, 5 aa, Solanum lycopersicum
STQDD

SEQ ID NO: 2570 - protein, 5 aa, Solanum tuberosum
KTHDD

SEQ ID NO: 2571 - protein, 5 aa, Solanum tuberosum
NTNAD

SEQ ID NO: 2572 - protein, 5 aa, Solanum tuberosum
TTNAD

SEQ ID NO: 2573 - protein, 5 aa, Solanum tuberosum
TTNAD

SEQ ID NO: 2574 - protein, 5 aa, Solanum tuberosum
TRNSD

SEQ ID NO: 2575 - protein, 5 aa, Solanum tuberosum
NTNAD

SEQ ID NO: 2576 - protein, 5 aa, Solanum tuberosum
NTNAD

SEQ ID NO: 2577 - protein, 5 aa, Solanum tuberosum
TTNAD

SEQ ID NO: 2578 - protein, 5 aa, Solanum brevidens
TSNSD

SEQ ID NO: 2579 - protein, 5 aa, Solanum tuberosum
KTHDD

SEQ ID NO: 2580 - protein, 5 aa, Hyoscyamus niger
NVESD

SEQ ID NO: 2581 - protein, 5 aa, Musca domestica
YSHDV

SEQ ID NO: 2582 - protein, 5 aa, Aedes aegypti
LTHSE

SEQ ID NO: 2583 - protein, 5 aa, Aedes aegypti
LTHSE

SEQ ID NO: 2584 - protein, 5 aa, Anopheles gambiae
LTHRD

SEQ ID NO: 2585 - protein, 8 aa, Mesembryanthemum crystallinum
REDQGPPF

SEQ ID NO: 2586 - protein, 8 aa, Mirabilis jalapa
NENVGPPY

SEQ ID NO: 2587 - protein, 8 aa, Mirabilis jalapa
NENVGPPY

SEQ ID NO: 2588 - protein, 8 aa, Phytolacca Americana
NASAGPPY

SEQ ID NO: 2589 - protein, 8 aa, Phytolacca Americana
NASAGPPY

SEQ ID NO: 2590 - protein, 8 aa, Phytolacca Americana
VASGGPPY

SEQ ID NO: 2591 - protein, 5 aa, Petunia hybrid
INKKP

SEQ ID NO: 2592 - protein, 5 aa, Petunia hybrid
INKAP

SEQ ID NO: 2593 - protein, 7 aa, Pisum sativum
SPFEMPP

SEQ ID NO: 2594 - protein, 7 aa, Pisum sativum
SPFEMPP

SEQ ID NO: 2595 - protein, 7 aa, Pisum sativum
SPFDIPP

SEQ ID NO: 2596 - protein, 7 aa, Pisum sativum
SPFEMPP

SEQ ID NO: 2597 - protein, 7 aa, Pisum sativum
SPFEMPP

SEQ ID NO: 2598 - protein, 7 aa, Pisum sativum
SPFEMPP

SEQ ID NO: 2599 - protein, 7 aa, Glycine soja
SPFEVPP

SEQ ID NO: 2600 - protein, 7 aa, Phaseolus angularis
SPFQMPP

SEQ ID NO: 2601 - protein, 7 aa, Phaseolus angularis
SPFEMPP

SEQ ID NO: 2602 - protein, 7 aa, Glycine max
SPFEVPP

SEQ ID NO: 2603 - protein, 7 aa, Medicago truncatula
SQRRGNS

SEQ ID NO: 2604 - protein, 7 aa, Medicago truncatula
SRALPNP

SEQ ID NO: 2605 - protein, 7 aa, Medicago truncatula
SQYESNA

SEQ ID NO: 2606 - protein, 7 aa, Vicia hirsute
SPFEMPP

SEQ ID NO: 2607 - protein, 7 aa, Trigonella foenum-graecum
SPFEMPP

SEQ ID NO: 2608 - protein, 7 aa, Onobrychis viciifolia
SPFEMPP

SEQ ID NO: 2609 - protein, 7 aa, Mundulea sericea
SPFEMPP

SEQ ID NO: 2610 - protein, 7 aa, Melilotus alba
SSFEMPP

SEQ ID NO: 2611 - protein, 7 aa, Philenoptera violacea
SPFEMPP

SEQ ID NO: 2612 - protein, 7 aa, Canavalia brasiliensis
SPFEMPP

SEQ ID NO: 2613 - protein, 7 aa, Bituminaria bituminosa
FPFQMPP

SEQ ID NO: 2614 - protein, 7 aa, Bituminaria bituminosa
SPFERPL

SEQ ID NO: 2615 - protein, 7 aa, Bituminaria bituminosa
SPFEMPP

SEQ ID NO: 2616 - protein, 7 aa, Phaseolus vulgaris
SPFERPP

SEQ ID NO: 2617 - protein, 7 aa, Glycine max
SPFEMPP

SEQ ID NO: 2618 - protein, 7 aa, Medicago truncatula
SPFEMPP

SEQ ID NO: 2619 - protein, 10 aa, Mesobuthus martensii
FTTDANMARK

SEQ ID NO: 2620 - protein, 10 aa, Mesobuthus martensii
FTTDANMARK

SEQ ID NO: 2621 - protein, 10 aa, Mesobuthus tamulus
FTTDPQTQAK

SEQ ID NO: 2622 - protein, 10 aa, Mesobuthus eupeus
FTTRPDMAQQ

SEQ ID NO: 2623 - protein, 10 aa, Buthus sindicus
FTTDPQMSKK

SEQ ID NO: 2624 - protein, 10 aa, Leiurus quinquestratus hebraeus
FTTDHQMEQK

SEQ ID NO: 2625 - protein, 10 aa, Mesobuthus eupeus
FTTDHQTARR

SEQ ID NO: 2626 - protein, 10 aa, Mesobuthus tamulus
FTTNPNMEAD

SEQ ID NO: 2627 - protein, 10 aa, Mesobuthus eupeus
FTTDHNMAKK

SEQ ID NO: 2628 - protein, 10 aa, Mesobuthus eupeus
FTTDPNMAKK

SEQ ID NO: 2629 - protein, 10 aa, Leiurus quinquestratus hebraeus
FTTDQQMTKK

SEQ ID NO: 2630 - protein, 10 aa, Buthus sindicus
FTKDPETEKK

SEQ ID NO: 2631 - protein, 10 aa, Leiurus quinquestratus quinquestratus
FTTDHQMARK

SEQ ID NO: 2632 - protein, 10 aa, Mesobuthus eupeus
FTTDPYTESK

SEQ ID NO: 2633 - protein, 10 aa, Mesobuthus eupeus
FTTDPNMANK

SEQ ID NO: 2634 - protein, 5 aa, Pandinus imperator
KADND

SEQ ID NO: 2635 - protein, 5 aa, Opistophthalmus carinatus
KENND

SEQ ID NO: 2636 - protein, 5 aa, Opistophthalmus carinatus
KENND

SEQ ID NO: 2637 - protein, 5 aa, Mesobuthus martensii
NSDGD

SEQ ID NO: 2638 - protein, 5 aa, Scorpio maurus palmatus
KENKD

SEQ ID NO: 2639 - protein, 8 aa, Centruroides noxius
AKYGYYQE

SEQ ID NO: 2640 - protein, 8 aa, Centruroides elegans
AKYGYYQE

SEQ ID NO: 2641 - protein, 8 aa, Centruroides gracilis
AKYGHYQE

SEQ ID NO: 2642 - protein, 8 aa, Centruroides sculpturatus
AKYGYYQE

SEQ ID NO: 2643 - protein, 8 aa, Centruroides limpidus limpidus
SKYGYYQE

SEQ ID NO: 2644 - protein, 8 aa, Centruroides exilicauda
AKYGYYQE

SEQ ID NO: 2645 - protein, 8 aa, Centruroides noxius
AKYGYYSQ

SEQ ID NO: 2646 - protein, 8 aa, Centruroides elegans
AKYGYYQQ

SEQ ID NO: 2647 - protein, 8 aa, Centruroides sculpturatus
AKYGYYGQ

SEQ ID NO: 2648 - protein, 8 aa, Centruroides gracilis
QKYGNYAQ

SEQ ID NO: 2649 - protein, 8 aa, Centruroides limpidus limpidus
SKYGYYGQ

SEQ ID NO: 2650 - protein, 8 aa, Centruroides noxius
GKYGYYQE

SEQ ID NO: 2651 - protein, 8 aa, Centruroides exilicauda
GKYGYYGQ

SEQ ID NO: 2652 - protein, 8 aa, Centruroides exilicauda
AKYGYYYQ

SEQ ID NO: 2653 - protein, 8 aa, Centruroides exilicauda
AKYGYYYQ

SEQ ID NO: 2654 - protein, 8 aa, Centruroides limpidus limpidus
SKYGYYGQ

SEQ ID NO: 2655 - protein, 8 aa, Centruroides limpidus limpidus
AKYGYYGQ

SEQ ID NO: 2656 - protein, 8 aa, Centruroides elegans
GKYGYYHQ

SEQ ID NO: 2657 - protein, 8 aa, Centruroides sculpturatus
GKYGYYGQ

SEQ ID NO: 2658 - protein, 8 aa, Centruroides sculpturatus
GKYGYYGQ

SEQ ID NO: 2659 - protein, 8 aa, Centruroides sculpturatus
GKYGYYGQ

SEQ ID NO: 2660 - protein, 8 aa, Centruroides sculpturatus
GKYGYYGQ

SEQ ID NO: 2661 - protein, 8 aa, Centruroides sculpturatus
GKYGYYGQ

SEQ ID NO: 2662 - protein, 8 aa, Centruroides sculpturatus
AKYGYYGQ

SEQ ID NO: 2663 - protein, 8 aa, Centruroides gracilis
QKYGPYGQ

SEQ ID NO: 2664 - protein, 5 aa, Momordica charantia
KRDSD

SEQ ID NO: 2665 - protein, 5 aa, Momordica charantia
KRDSD

SEQ ID NO: 2666 - protein, 5 aa, Lagenaria siceraria
KHDSD

SEQ ID NO: 2667 - protein, 5 aa, Citrullus lanatus
KRDAD

SEQ ID NO: 2668 - protein, 5 aa, Cucurbita maxima
KKDSD

SEQ ID NO: 2669 - protein, 5 aa, Luffa cylindrical
SSDSD

SEQ ID NO: 2670 - protein, 5 aa, Momordica charantia
KRDSD

SEQ ID NO: 2671 - protein, 5 aa, Momordica cochinchinensis
RRDSD

SEQ ID NO: 2672 - protein, 5 aa, Momordica repens
KRDSD

SEQ ID NO: 2673 - protein, 5 aa, Momordica repens
KVNDD

SEQ ID NO: 2674 - protein, 5 aa, Trichosanthes kirilowii
KHDSD

SEQ ID NO: 2675 - protein, 5 aa, Cucumis sativus
KRDSD

SEQ ID NO: 2676 - protein, 5 aa, Bryonia dioica
KQDSD

SEQ ID NO: 2677 - protein, 5 aa, Ecballium elaterium
SSDSD

SEQ ID NO: 2678 - protein, 5 aa, Luffa cylindrical
KRDSD

SEQ ID NO: 2679 - protein, 5 aa, Momordocia charantia
RRDSD

SEQ ID NO: 2680 - protein, 5 aa, Momordocia cochinchinensis
KRDSD

SEQ ID NO: 2681 - protein, 5 aa, Sechium edule
KQDSD

SEQ ID NO: 2682 - protein, 5 aa, Cucumis melo
KKDSD

SEQ ID NO: 2683 - protein, 5 aa, Cucurbita pepo
KADSD

SEQ ID NO: 2684 - protein, 5 aa, Cyclanthera pedata
SSDSD

SEQ ID NO: 2685 - protein, 5 aa, Luffa cylindrical
KQDSD

SEQ ID NO: 2686 - protein, 5 aa, Momordica charantia
RRDSD

SEQ ID NO: 2687 - protein, 5 aa, Momordica cochinchinensis
KKDSD

SEQ ID NO: 2688 - protein, 5 aa, Cucurbita maxima
KHDSD

SEQ ID NO: 2689 - protein, 5 aa, Cucumis sativus
KADSD

SEQ ID NO: 2690 - protein, 5 aa, Luffa cylindrical
SSDSD

SEQ ID NO: 2691 - protein, 5 aa, Cyclanthera pedata
KADSD

SEQ ID NO: 2692 - protein, 5 aa, Luffa cylindrical
KTDDD

SEQ ID NO: 2693 - protein, 5 aa, Sechium edule
KLDTD

SEQ ID NO: 2694 - protein, 5 aa, Cyclanthera pedata
KKDSD

SEQ ID NO: 2695 - protein, 5 aa, Cyclanthera pedata
KKDSD

SEQ ID NO: 2696 - protein, 5 aa, Momordica charantia
TRDSD

SEQ ID NO: 2697 - protein, 5 aa, Cucumis melo
KTDRD

SEQ ID NO: 2698 - protein, 5 aa, Cucumis melo
KQDSD

SEQ ID NO: 2699 - protein, 5 aa, Cucumis melo
KQDSD

SEQ ID NO: 2700 - protein, 7 aa, Mirabilis jalapa
PPNAPNY

SEQ ID NO: 2701 - protein, 8 aa, Spinacia oleracea
SGFGPPEQ

SEQ ID NO: 2702 - protein, 8 aa, Spinacia oleracea
SGFGPPEQ

SEQ ID NO: 2703 - protein, 8 aa, Spinacia oleracea
SGFGPPEQ

SEQ ID NO: 2704 - protein, 4 aa, Ancylometes
AEDE

SEQ ID NO: 2705 - protein, 5 aa, Atrax robustus
PYNEH

SEQ ID NO: 2706 - protein, 5 aa, Atrax robustus
PYNES

SEQ ID NO: 2707 - protein, 5 aa, Atrax robustus
PYNEN

SEQ ID NO: 2708 - protein, 5 aa, Atrax robustus
PYNEN

SEQ ID NO: 2709 - protein, 5 aa, Atrax robustus
PYNEN

SEQ ID NO: 2710 - protein, 6 aa, Lycosa kazakhstanicus
MHNDKG

SEQ ID NO: 2711 - protein, 6 aa, Lycosa kazakhstanicus
MHNDKG

SEQ ID NO: 2712 - protein, 6 aa, Lycosa kazakhstanicus
MHNDKG

SEQ ID NO: 2713 - protein, 6 aa, Lycosa kazakhstanicus
MHNDKG

SEQ ID NO: 2714 - protein, 6 aa, Lycosa kazakhstanicus
MHYDKG

SEQ ID NO: 2715 - protein, 6 aa, Lycosa kazakhstanicus
MHNDKG

SEQ ID NO: 2716 - protein, 6 aa, Lycosa kazakhstanicus
VHNDKG

SEQ ID NO: 2717 - protein, 5 aa, Grammostola rosea
DSERK

SEQ ID NO: 2718 - protein, 5 aa, Grammostola rosea
DEERK

SEQ ID NO: 2719 - protein, 5 aa, Chilobrachys juingzhao
TVHSD

SEQ ID NO: 2720 - protein, 6 aa, Chilobrachys juingzhao
GRGKPP

SEQ ID NO: 2721 - protein, 5 aa, Chilobrachys juingzhao
TTDSD

SEQ ID NO: 2722 - protein, 6 aa, Chilobrachys juingzhao
DGKSTF

SEQ ID NO: 2723 - protein, 6 aa, Chilobrachys juingzhao
DGKSTF

SEQ ID NO: 2724 - protein, 5 aa, Chilobrachys juingzhao
PKKAP

SEQ ID NO: 2725 - protein, 5 aa, Chilobrachys juingzhao
PKKAP

SEQ ID NO: 2726 - protein, 5 aa, Chilobrachys juingzhao
PKKAP

SEQ ID NO: 2727 - protein, 5 aa, Chilobrachys juingzhao
PKTAP

SEQ ID NO: 2728 - protein, 7 aa, Chilobrachys juingzhao
RPLMRIP

SEQ ID NO: 2729 - protein, 5 aa, Chilobrachys juingzhao
DSERK

SEQ ID NO: 2730 - protein, 5 aa, Chilobrachys juingzhao
DSERK

SEQ ID NO: 2731 - protein, 6 aa, Chilobrachys juingzhao
GEGKPP

SEQ ID NO: 2732 - protein, 6 aa, Chilobrachys juingzhao
GEGKPP

SEQ ID NO: 2733 - protein, 5 aa, Chilobrachys juingzhao
STEKP

SEQ ID NO: 2734 - protein, 6 aa, Chilobrachys juingzhao
HPGQPP

SEQ ID NO: 2735 - protein, 6 aa, Chilobrachys juingzhao
HPGQPP

SEQ ID NO: 2736 - protein, 6 aa, Chilobrachys juingzhao
GGKSTF

SEQ ID NO: 2737 - protein, 6 aa, Chilobrachys juingzhao
DGKSTF

SEQ ID NO: 2738 - protein, 6 aa, Chilobrachys juingzhao
DGKSTF

SEQ ID NO: 2739 - protein, 6 aa, Chilobrachys juingzhao
DGKSTF

SEQ ID NO: 2740 - protein, 6 aa, Chilobrachys juingzhao
GAGKPT

SEQ ID NO: 2741 - protein, 6 aa, Chilobrachys juingzhao
GAGKPT

SEQ ID NO: 2742 - protein, 6 aa, Chilobrachys juingzhao
GAGKPT

SEQ ID NO: 2743 - protein, 5 aa, Chilobrachys juingzhao
KKDSE

SEQ ID NO: 2744 - protein, 5 aa, Chilobrachys juingzhao
KKDSE

SEQ ID NO: 2745 - protein, 5 aa, Chilobrachys juingzhao
KKDSE

SEQ ID NO: 2746 - protein, 5 aa, Chilobrachys juingzhao
SSDKP

SEQ ID NO: 2747 - protein, 6 aa, Chilobrachys juingzhao
GSGKPA

SEQ ID NO: 2748 - protein, 6 aa, Chilobrachys juingzhao
GSGKPA

SEQ ID NO: 2749 - protein, 5 aa, Chilobrachys juingzhao
SKHED

SEQ ID NO: 2750 - protein, 5 aa, Chilobrachys juingzhao
SKHED

SEQ ID NO: 2751 - protein, 5 aa, Chilobrachys juingzhao
SVDSD

SEQ ID NO: 2752 - protein, 5 aa, Chilobrachys juingzhao
SVDSD

SEQ ID NO: 2753 - protein, 5 aa, Chilobrachys juingzhao
SVDSD

SEQ ID NO: 2754 - protein, 5 aa, Chilobrachys juingzhao
SVDSD

SEQ ID NO: 2755 - protein, 5 aa, Chilobrachys juingzhao
SVDSD

SEQ ID NO: 2756 - protein, 5 aa, Chilobrachys juingzhao
SVHSD

SEQ ID NO: 2757 - protein, 5 aa, Chilobrachys juingzhao
ADSDD

SEQ ID NO: 2758 - protein, 5 aa, Chilobrachys juingzhao
ADSDD

SEQ ID NO: 2759 - protein, 5 aa, Chilobrachys juingzhao
ADSDD

SEQ ID NO: 2760 - protein, 5 aa, Chilobrachys juingzhao
ADSDD

SEQ ID NO: 2761 - protein, 6 aa, Chilobrachys juingzhao
TPEKND

SEQ ID NO: 2762 - protein, 6 aa, Chilobrachys juingzhao
NPDNDK

SEQ ID NO: 2763 - protein, 6 aa, Chilobrachys juingzhao
NPDNDK

SEQ ID NO: 2764 - protein, 5 aa, Chilobrachys juingzhao
SEDSE

SEQ ID NO: 2765 - protein, 5 aa, Chilobrachys juingzhao
SEDSE

SEQ ID NO: 2766 - protein, 5 aa, Chilobrachys juingzhao
TKDSE

SEQ ID NO: 2767 - protein, 5 aa, Chilobrachys juingzhao
SKDGD

SEQ ID NO: 2768 - protein, 5 aa, Chilobrachys juingzhao
SKDAD

SEQ ID NO: 2769 - protein, 5 aa, Chilobrachys juingzhao
TKDED

SEQ ID NO: 2770 - protein, 5 aa, Chilobrachys juingzhao
TKDED

SEQ ID NO: 2771 - protein, 5 aa, Chilobrachys juingzhao
EKDSD

SEQ ID NO: 2772 - protein, 5 aa, Chilobrachys juingzhao
EKDSD

SEQ ID NO: 2773 - protein, 5 aa, Chilobrachys juingzhao
EKDSD

SEQ ID NO: 2774 - protein, 5 aa, Chilobrachys juingzhao
EKDSD

SEQ ID NO: 2775 - protein, 5 aa, Chilobrachys juingzhao
EKDSD

SEQ ID NO: 2776 - protein, 5 aa, Chilobrachys juingzhao
TTDSD

SEQ ID NO: 2777 - protein, 5 aa, Chilobrachys juingzhao
TTDSD

SEQ ID NO: 2778 - protein, 5 aa, Chilobrachys juingzhao
KAHED

SEQ ID NO: 2779 - protein, 5 aa, Chilobrachys juingzhao
KTNQD

SEQ ID NO: 2780 - protein, 5 aa, Chilobrachys juingzhao
KTNQD

SEQ ID NO: 2781 - protein, 5 aa, Chilobrachys juingzhao
SVDSD

SEQ ID NO: 2782 - protein, 6 aa, Chilobrachys juingzhao
NYMDDK

SEQ ID NO: 2783 - protein, 7 aa, Chilobrachys juingzhao
EVEAGLP

SEQ ID NO: 2784 - protein, 7 aa, Chilobrachys juingzhao
EVEAGLP

SEQ ID NO: 2785 - protein, 7 aa, Chilobrachys juingzhao
GVEAGLP

SEQ ID NO: 2786 - protein, 6 aa, Chilobrachys juingzhao
EDENSP

SEQ ID NO: 2787 - protein, 6 aa, Chilobrachys juingzhao
EDENSP

SEQ ID NO: 2788 - protein, 9 aa, Chilobrachys juingzhao
PNDRPGHRT

SEQ ID NO: 2789 - protein, 5 aa, Chilobrachys juingzhao
KSDSD

SEQ ID NO: 2790 - protein, 5 aa, Chilobrachys juingzhao
ETSED

SEQ ID NO: 2791 - protein, 5 aa, Calisoga sp
SNSKD

SEQ ID NO: 2792 - protein, 5 aa, Calisoga sp
SNSKD

SEQ ID NO: 2793 - protein, 5 aa, Calisoga sp
SNSKD

SEQ ID NO: 2794 - protein, 5 aa, Ctenus ornatus
KSDDE

SEQ ID NO: 2795 - protein, 5 aa, Chilobrachys juingzhao
SVDSD

SEQ ID NO: 2796 - protein, 5 aa, Chilobrachys juingzhao
DSERK

SEQ ID NO: 2797 - protein, 6 aa, Chilobrachys juingzhao
GEGKPP

SEQ ID NO: 2798 - protein, 6 aa, Chilobrachys juingzhao
GRGKPP

SEQ ID NO: 2799 - protein, 5 aa, Chilobrachys juingzhao
DSKRA

SEQ ID NO: 2800 - protein, 6 aa, Chilobrachys juingzhao
DGKSTF

SEQ ID NO: 2801 - protein, 5 aa, Grammostoal rosea
DEERK

SEQ ID NO: 2802 - protein, 6 aa, Grammostoal rosea
NPNDDK

SEQ ID NO: 2803 - protein, 4 aa, Agelena orientalis
HNIH

SEQ ID NO: 2804 - protein, 6 aa, Agelena orientalis
RSWYND

SEQ ID NO: 2805 - protein, 6 aa, Agelena orientalis
RDWYND

SEQ ID NO: 2806 - protein, 7 aa, Agelena orientalis
ADWAGLH

SEQ ID NO: 2807 - protein, 7 aa, Agelena orientalis
ADWARPH

SEQ ID NO: 2808 - protein, 7 aa, Agelena orientalis
ANWAGPH

SEQ ID NO: 2809 - protein, 7 aa, Agelena orientalis
ADWSGPY

SEQ ID NO: 2810 - protein, 7 aa, Agelena orientalis
ADWSGPY

SEQ ID NO: 2811 - protein, 7 aa, Agelena orientalis
ADWSGPY

SEQ ID NO: 2812 - protein, 7 aa, Agelena orientalis
ADWAGPH

SEQ ID NO: 2813 - protein, 7 aa, Agelena orientalis
ADWAGPY

SEQ ID NO: 2814 - protein, 7 aa, Agelena orientalis
ADWAGPH

SEQ ID NO: 2815 - protein, 7 aa, Agelena orientalis
ADWAGPY

SEQ ID NO: 2816 - protein, 7 aa, Agelena orientalis
ADWAGPW

SEQ ID NO: 2817 - protein, 5 aa, Agelena orientalis
ENGET

SEQ ID NO: 2818 - protein, 7 aa, Agelena orientalis
ADWAGPH

SEQ ID NO: 2819 - protein, 7 aa, Agelena orientalis
NPSSGPR

SEQ ID NO: 2820 - protein, 7 aa, Agelena orientalis
NPSSGPR

SEQ ID NO: 2821 - protein, 7 aa, Agelena orientalis
NPSSGPR

SEQ ID NO: 2822 - protein, 7 aa, Agelena orientalis
NPSSGPR

SEQ ID NO: 2823 - protein, 7 aa, Agelena orientalis
NALSGPR

SEQ ID NO: 2824 - protein, 7 aa, Agelena orientalis
NALSGPR

SEQ ID NO: 2825 - protein, 7 aa, Agelena orientalis
NALTGPR

SEQ ID NO: 2826 - protein, 7 aa, Agelena orientalis
NALSGPR

SEQ ID NO: 2827 - protein, 7 aa, Agelena orientalis
NALSGPR

SEQ ID NO: 2828 - protein, 7 aa, Agelena orientalis
NALSGPR

SEQ ID NO: 2829 - protein, 7 aa, Agelena orientalis
NALSGPR

SEQ ID NO: 2830 - protein, 7 aa, Agelena orientalis
NALSDPR

SEQ ID NO: 2831 - protein, 7 aa, Agelena orientalis
NALSGPR

SEQ ID NO: 2832 - protein, 7 aa, Agelena orientalis
NALSGPR

SEQ ID NO: 2833 - protein, 7 aa, Agelena orientalis
NALSGPR

SEQ ID NO: 2834 - protein, 7 aa, Agelena orientalis
NALSGPR

SEQ ID NO: 2835 - protein, 7 aa, Agelena orientalis
NALSGPR

SEQ ID NO: 2836 - protein, 7 aa, Segestria florentina
YIHNHND

SEQ ID NO: 2837 - protein, 7 aa, Segestria florentina
YIHNHNN

SEQ ID NO: 2838 - protein, 7 aa, Segestria florentina
YIHNHND

SEQ ID NO: 2839 - protein, 7 aa, Segestria florentina
YIHNHND

SEQ ID NO: 2840 - protein, 7 aa, Segestria florentina
YIHNHND

SEQ ID NO: 2841 - protein, 7 aa, Segestria florentina
YIHNHND

SEQ ID NO: 2842 - protein, 7 aa, Segestria florentina
YIHNHND

SEQ ID NO: 2843 - protein, 7 aa, Segestria florentina
YIHNHND

SEQ ID NO: 2844 - protein, 5 aa, Phoneutria nigriventer
TSDGQ

SEQ ID NO: 2845 - protein, 7 aa, Tachypleus tridentatus
RTWSPPN

SEQ ID NO: 2846 - protein, 5 aa, Hadronyche formidabilis
AACCP

SEQ ID NO: 2847 - protein, 5 aa, Hadronyche versuta
AACCP

SEQ ID NO: 2848 - protein, 5 aa, Hadronyche versuta
AACCP

SEQ ID NO: 2849 - protein, 5 aa, Hadronyche versuta
AACCP

SEQ ID NO: 2850 - protein, 6 aa, Agelenopsis aperta
KWGGTP

SEQ ID NO: 2851 - protein, 6 aa, Agelenopsis aperta
TWGGTK

SEQ ID NO: 2852 - protein, 6 aa, Missulena bradleyi
QPNTQP

SEQ ID NO: 2853 - protein, 5 aa, Atrax robustus
PYNEH

SEQ ID NO: 2854 - protein, 5 aa, Hadronyche infensa
PYHES

SEQ ID NO: 2855 - protein, 5 aa, Hadronyche versuta
PYNEN

SEQ ID NO: 2856 - protein, 5 aa, Hadronyche formidabilis
PYNEN

SEQ ID NO: 2857 - protein, 5 aa, Hadronyche infensa
PYNEN

SEQ ID NO: 2858 - protein, 5 aa, Hdronyche versuta
PYNEN

SEQ ID NO: 2859 - protein, 5 aa, Hadronyche infensa
PYNES

SEQ ID NO: 2860 - protein, 5 aa, Hadronyche versuta
PYNEN

SEQ ID NO: 2861 - protein, 5 aa, Hadronyche versuta
PYNEN

SEQ ID NO: 2862 - protein, 5 aa, Hadronyche versuta
PYNEN

SEQ ID NO: 2863 - protein, 5 aa, Hadronyche versuta
PYSKY

SEQ ID NO: 2864 - protein, 5 aa, Atrax
SPDAN

SEQ ID NO: 2865 - protein, 5 aa, Hadronyche infensa
SSDKD

SEQ ID NO: 2866 - protein, 5 aa, Hadronyche versuta
SSNRD

SEQ ID NO: 2867 - protein, 5 aa, Atrax
SSDAN

SEQ ID NO: 2868 - protein, 5 aa, Hadronyche infensa
SSDKD

SEQ ID NO: 2869 - protein, 6 aa, Cupiennius salei
TDDRHS

SEQ ID NO: 2870 - protein, 5 aa, Phoneutria nigriventer
TSDGQ

SEQ ID NO: 2871 - protein, 5 aa, Phoneturia reidyi
TSDGQ

SEQ ID NO: 2872 - protein, 4 aa, Phoneutria keyserlingi
DNLP

SEQ ID NO: 2873 - protein, 6 aa, Lycosa kazakhstanicus
MHNDKG

SEQ ID NO: 2874 - protein, 6 aa, Certagyrus marshalli
DPKNDK

SEQ ID NO: 2875 - protein, 5 aa, Grammostola rosea
DSKRK

SEQ ID NO: 2876 - protein, 5 aa, Heteroscodra maculata
SSTSD

SEQ ID NO: 2877 - protein, 5 aa, Psalmopoeus cambridgei
DSTLD

SEQ ID NO: 2878 - protein, 5 aa, Stromatopelma calceatum griseipes
KTTAD

SEQ ID NO: 2879 - protein, 5 aa, Stromatopelma calceatum
RRDSD

SEQ ID NO: 2880 - protein, 6 aa, Theraphosa blondi
DPNNDK

SEQ ID NO: 2881 - protein, 5 aa, Phoneutria keyserlingi
TSDGQ

SEQ ID NO: 2882 - protein, 6 aa, Phoneutria keyserlingi
KEDRNG

SEQ ID NO: 2883 - protein, 5 aa, Phoneutria nigriventer
KSDED

SEQ ID NO: 2884 - protein, 5 aa, Phoneutria nigriventer
TSDGQ

SEQ ID NO: 2885 - protein, 5 aa, Phoneutria nigriventer
NSDKE

SEQ ID NO: 2886 - protein, 5 aa, Phoneutria reidyi
FRDKE

SEQ ID NO: 2887 - protein, 5 aa, Phoneutria nigriventer
KSDEN

SEQ ID NO: 2888 - protein, 6 aa, Ceratogyrus marshalli
DPKNDK

SEQ ID NO: 2889 - protein, 5 aa, Heteroscodra maculata
NDEMV

SEQ ID NO: 2890 - protein, 5 aa, Psalmopoeus cambridgei
KSTSD

SEQ ID NO: 2891 - protein, 6 aa, Theraphosa blondi
DPKNDK

SEQ ID NO: 2892 - protein, 6 aa, Phoneutria nigriventer
GKGYKR

SEQ ID NO: 2893 - protein, 10 aa, Segestria florentina
THSRSMKNGL

SEQ ID NO: 2894 - protein, 5 aa, Phoneutria keyserlingi
FSDKL

SEQ ID NO: 2895 - protein, 6 aa, Phoneutria nigriventer
GKGASP

SEQ ID NO: 2896 - protein, 5 aa, Phoneutria nigriventer
NHPRT

SEQ ID NO: 2897 - protein, 6 aa, Phoneutria nigriventer
KEDRNG

SEQ ID NO: 2898 - protein, 6 aa, Phoneutria nigriventer
KFDRHG

SEQ ID NO: 2899 - protein, 6 aa, Phoneutria reidyi
GKGVNT

SEQ ID NO: 2900 - protein, 6 aa, Phoneutria nigriventer
WYPEKP

SEQ ID NO: 2901 - protein, 5 aa, Ceratogyrus marshalli
TIDDD

SEQ ID NO: 2902 - protein, 9 aa, Loxosceles intermedia
GSPHGLPSN

SEQ ID NO: 2903 - protein, 6 aa, Paraphysa scrofa
NPSNDK

SEQ ID NO: 2904 - protein, 5 aa, Psalmopeoeus cambridgei
KEDSE

SEQ ID NO: 2905 - protein, 6 aa, Theraphosa blondi
DPNNDK

SEQ ID NO: 2906 - protein, 5 aa, Hysterocrates gigas
SVNDD

SEQ ID NO: 2907 - protein, 5 aa, Heteropoda venatoria
TSDSD

SEQ ID NO: 2908 - protein, 5 aa, Heteropoda venatoria
ESNAD

SEQ ID NO: 2909 - protein, 7 aa, Allagelena opulenta
NALSGPR

SEQ ID NO: 2910 - protein, 7 aa, Agelena orientalis
NALSGPR

SEQ ID NO: 2911 - protein, 6 aa, Cupiennius salei
TNDKHN

SEQ ID NO: 2912 - protein, 6 aa, Hololena curta
RSAYED

SEQ ID NO: 2913 - protein, 7 aa, Hololena curta
ADWAGPY

SEQ ID NO: 2914 - protein, 7 aa, Hololena curta
ADWFGPY

SEQ ID NO: 2915 - protein, 4 aa, Phoneutria nigriventer
HDIH

SEQ ID NO: 2916 - protein, 4 aa, Phoneutria reidyi
DSLK

SEQ ID NO: 2917 - protein, 6 aa, Cupiennius salei
TNDKKN

SEQ ID NO: 2918 - protein, 7 aa, Pireneitega luctuosa
ADWSGPS

SEQ ID NO: 2919 - protein, 7 aa, Pireneitega luctuosa
ASWSGPY

SEQ ID NO: 2920 - protein, 7 aa, Pireneitega luctuosa
ADWSGPS

SEQ ID NO: 2921 - protein, 7 aa, Pireneitega luctuosa
ASWAGPY

SEQ ID NO: 2922 - protein, 5 aa, Hadronyche versuta
GKTED

SEQ ID NO: 2923 - protein, 8 aa, Psalmopoeus cambridgei
VYVPAQNP

SEQ ID NO: 2924 - protein, 8 aa, Psalmopoeus cambridgei
VRGPMRVP

SEQ ID NO: 2925 - protein, 6 aa, Ctenus ornatus
WYPQKP

SEQ ID NO: 2926 - protein, 6 aa, Chilobrachys jingzhao
GSGKPA

SEQ ID NO: 2927 - protein, 6 aa, Chilobrachys jingzhao
GSGKPA

SEQ ID NO: 2928 - protein, 5 aa, Chilobrachys jingzhao
SVDSD

SEQ ID NO: 2929 - protein, 8 aa, Haplopelma schmidti
YGATQKIP

SEQ ID NO: 2930 - protein, 6 aa, Haplopelma schmidti
TPGKNE

SEQ ID NO: 2931 - protein, 4 aa, Haplopelma schmidti
KEKL

SEQ ID NO: 2932 - protein, 6 aa, Haplopelma schmidti
NPSNDQ

SEQ ID NO: 2933 - protein, 5 aa, Haplopelma schmidti
SQDGD

SEQ ID NO: 2934 - protein, 5 aa, Haplopelma schmidti
VAGIG

SEQ ID NO: 2935 - protein, 6 aa, Haplopelma hainanum
VPGKNE

SEQ ID NO: 2936 - protein, 6 aa, Haplopelma hainanum
TPGKNE

SEQ ID NO: 2937 - protein, 6 aa, Haplopelma hainanum
NPSNDQ

SEQ ID NO: 2938 - protein, 6 aa, Haplopelma hainanum
NPSNDQ

SEQ ID NO: 2939 - protein, 5 aa, Grammostola rosea
KTTSD

SEQ ID NO: 2940 - protein, 5 aa, Grammostola rosea
KTTAD

SEQ ID NO: 2941 - protein, 6 aa, Heteropoda venatoria
GTDQSE

SEQ ID NO: 2942 - protein, 5 aa, Diguetia canities
DTNAD

SEQ ID NO: 2943 - protein, 5 aa, Diguetia canities
STHAD

SEQ ID NO: 2944 - protein, 4 aa, Heteropoda venatoria
RGKT

SEQ ID NO: 2945 - protein, 4 aa, Hapopelma schmidti
DSGE

SEQ ID NO: 2946 - protein, 5 aa, Lasiodora
DTSKD

SEQ ID NO: 2947 - protein, 5 aa, Macrothele gigas
DYNNG

SEQ ID NO: 2948 - protein, 6 aa, Macrothele gigas
DKDRPD

SEQ ID NO: 2949 - protein, 6 aa, Ctenus ornatus
EGSTVP

SEQ ID NO: 2950 - protein, 5 aa, Agelenopsis aperta
KKDKE

SEQ ID NO: 2951 - protein, 6 aa, Macrothele gigas
WYPQKP

SEQ ID NO: 2952 - protein, 6 aa, Agelenopsis aperta
RDWYDE

SEQ ID NO: 2953 - protein, 5 aa, ;PRT1;Macrothele gigas
TDRLP

SEQ ID NO: 2954 - protein, 7 aa, Agelenopsis aperta
ADWAGPW

SEQ ID NO: 2955 - protein, 5 aa, Macrothele gigas
NENLP

SEQ ID NO: 2956 - protein, 7 aa, Agelenopsis aperta
ADWAGPY

SEQ ID NO: 2957 - protein, 7 aa, Agelenopsis aperta
ADWAGPH

SEQ ID NO: 2958 - protein, 7 aa, Agelenopsis aperta
ADWAGPH

SEQ ID NO: 2959 - protein, 5 aa, ;PRT1;Macrothele gigas
KNKKE

SEQ ID NO: 2960 - protein, 7 aa, Agelenopsis aperta
ADWAGPH

SEQ ID NO: 2961 - protein, 9 aa, ;PRT1;Macrothele gigas
DPYSSDAPR

SEQ ID NO: 2962 - protein, 5 aa, ;PRT1;Macrothele gigas
VVGIG

SEQ ID NO: 2963 - protein, 5 aa, ;PRT1;Macrothele gigas
KKSSE

SEQ ID NO: 2964 - protein, 4 aa, ;PRT1;Macrothele gigas
VNGQ

SEQ ID NO: 2965 - protein, 5 aa, Paraphysa scrofa
DSARK

SEQ ID NO: 2966 - protein, 6 aa, Psalmopoeus cambridgei
VNRHGD

SEQ ID NO: 2967 - protein, 5 aa, Paraphysa scrofa
DEERK

SEQ ID NO: 2968 - protein, 5 aa, Apomastus schlingeri
TNADE

SEQ ID NO: 2969 - protein, 5 aa, Brachypelma smithi
KKDSD

SEQ ID NO: 2970 - protein, 6 aa, Apomastus schlingeri
GPWEWP

SEQ ID NO: 2971 - protein, 5 aa, Thrixopelma pruriens
SAGQT

SEQ ID NO: 2972 - protein, 5 aa, Thrixopelma pruriens
DSERK

SEQ ID NO: 2973 - protein, 5 aa, Macrothele gigas
NERLH

SEQ ID NO: 2974 - protein, 5 aa, Macrothele raveni
KNKKE

SEQ ID NO: 2975 - protein, 5 aa, Heteropoda venatoria
DSNAD

SEQ ID NO: 2976 - protein, 5 aa, Coremiocnemis valida
YKSGR

SEQ ID NO: 2977 - protein, 5 aa, Grammostola rosea
KNSND

SEQ ID NO: 2978 - protein, 5 aa, Grammostola rosea
DEERK

SEQ ID NO: 2979 - protein, 6 aa, Grammostola rosea
DPDNDK

SEQ ID NO: 2980 - protein, 5 aa, Grammostola rosea
SQTSD

SEQ ID NO: 2981 - protein, 7 aa, Asteropus simplex
TLDGTLA

SEQ ID NO: 2982 - protein, 5 aa, Terebra sublata
PHGNE

SEQ ID NO: 2983 - protein, 8 aa, Hyposoter fugitivus ichnovirus
MDLQFNKP

SEQ ID NO: 2984 - protein, 8 aa, Hyposoter fugitivus ichnovirus
TDIGRTEP

SEQ ID NO: 2985 - protein, 6 aa, Hyposoter fugitivus ichnovirus
MDTVKP

SEQ ID NO: 2986 - protein, 6 aa, Hyposoter fugitivus ichnovirus
MDTVKP

SEQ ID NO: 2987 - protein, 6 aa, Hyposoter fugitivus ichnovirus
LDAIAP

SEQ ID NO: 2988 - protein, 6 aa, Campoletis sonorensis ichnovirus
RGINKP

SEQ ID NO: 2989 - protein, 6 aa, Cotesia congregate bracovirus
DLRSNS

SEQ ID NO: 2990 - protein, 6 aa, Cotesia congregate bracovirus
MKSKLP

SEQ ID NO: 2991 - protein, 6 aa, Campoletis sonorensis ichnovirus
LGFGKP

SEQ ID NO: 2992 - protein, 6 aa, Campoletis sonorensis ichnovirus
LGFGKP

SEQ ID NO: 2993 - protein, 6 aa, Campoletis sonorensis ichnovirus
VHTTLP

SEQ ID NO: 2994 - protein, 6 aa, Campoletis sonorensis ichnovirus
VHTTLP

SEQ ID NO: 2995 - protein, 6 aa, Campoletis sonorensis ichnovirus
RGVSKP

SEQ ID NO: 2996 - protein, 6 aa, Campoletis sonorensis ichnovirus
LHTITP

SEQ ID NO: 2997 - protein, 6 aa, Campoletis sonorensis ichnovirus
LHTITP

SEQ ID NO: 2998 - protein, 6 aa, Campoletis sonorensis ichnovirus
RFSLTP

SEQ ID NO: 2999 - protein, 6 aa, Campoletis chlorideae ichnovirus
IESTKP

SEQ ID NO: 3000 - protein, 6 aa, Campoletis sonorensis ichnovirus
VNADKP

SEQ ID NO: 3001 - protein, 6 aa, Campoletis sp. Ichnovirus
QGMNKP

SEQ ID NO: 3002 - protein, 6 aa, Campoletis sonorensis ichnovirus
IESTKP

SEQ ID NO: 3003 - protein, 5 aa, Ectoropis oblique NPV
KYSYE

SEQ ID NO: 3004 - protein, 5 aa, Antheraea pernyi nuclear polyhedrosis virus
QYSYE

SEQ ID NO: 3005 - protein, 5 aa, Helicoverpa armigera granulovirus
QYSYE

SEQ ID NO: 3006 - protein, 5 aa, Orgyia leucostigma NPV
VHNDE

SEQ ID NO: 3007 - protein, 5 aa, Orgyia pseudotsugata multicapsid polyhedrosis virus
QYSYE

SEQ ID NO: 3008 - protein, 5 aa, Autographa californica nuclear polyhedrosis virus
VHNDE

SEQ ID NO: 3009 - protein, 5 aa, Anticarsia gemmatalis nuclear polyhedrosis virus
KYSYE

SEQ ID NO: 3010 - protein, 5 aa, Plutella xylostella multiple nucleopolyhedrovirus
VHNDE

SEQ ID NO: 3011 - protein, 5 aa, Antheraea pernyi nuclear polyhedrosis virus
IHNDE

SEQ ID NO: 3012 - protein, 5 aa, Mamestra configurata NPV-B
KYSYE

SEQ ID NO: 3013 - protein, 5 aa, Mamestra configurata NPV-A
KYSYE

SEQ ID NO: 3014 - protein, 5 aa, Xestia c-nigrum granulosis virus
QYSYE

SEQ ID NO: 3015 - protein, 4 aa, Hybanthus parviflorus
VYIP

SEQ ID NO: 3016 - protein, 4 aa, Chassalia parvifolia
VWIP

SEQ ID NO: 3017 - protein, 4 aa, Viola baoshanensis
VWIP

SEQ ID NO: 3018 - protein, 4 aa, Viola baoshanensis
VYLP

SEQ ID NO: 3019 - protein, 4 aa, Viola baoshanensis
VWIP

SEQ ID NO: 3020 - protein, 4 aa, Viola baoshanensis
VWIP

SEQ ID NO: 3021 - protein, 4 aa, Viola baoshanensis
VYIP

SEQ ID NO: 3022 - protein, 4 aa, Viola baoshanensis
VYIP

SEQ ID NO: 3023 - protein, 4 aa, Viola baoshanensis
VWIP

SEQ ID NO: 3024 - protein, 4 aa, Viola baoshanensis
VWIP

SEQ ID NO: 3025 - protein, 4 aa, Oldenlandia affinis
VYIP

SEQ ID NO: 3026 - protein, 4 aa, Oldenlandia affinis
VYIP

SEQ ID NO: 3027 - protein, 4 aa, Melicytus ramiflorus
VYLP

SEQ ID NO: 3028 - protein, 4 aa, Viola hederacea
VWIP

SEQ ID NO: 3029 - protein, 4 aa, Viola biflora
VWIP

SEQ ID NO: 3030 - protein, 4 aa, Viola odorata
FKFK

SEQ ID NO: 3031 - protein, 4 aa, Hybanthus floribundus E
VYIP

SEQ ID NO: 3032 - protein, 4 aa, Hybanthus floribundus E
TTFN

SEQ ID NO: 3033 - protein, 4 aa, Hybanthus floribundus E
VFIP

SEQ ID NO: 3034 - protein, 4 aa, Hybanthus floribundus E
AYFG

SEQ ID NO: 3035 - protein, 4 aa, Hybanthus floribundus E
VYIP

SEQ ID NO: 3036 - protein, 4 aa, Hybanthus floribundus E
VYLP

SEQ ID NO: 3037 - protein, 4 aa, Chassalia parvifolia
VWIP

SEQ ID NO: 3038 - protein, 4 aa, Chassalia parvifolia
VFIP

SEQ ID NO: 3039 - protein, 4 aa, Chassalia parvifolia
VWIP

SEQ ID NO: 3040 - protein, 4 aa, Chassalia parvifolia
VWIP

SEQ ID NO: 3041 - protein, 4 aa, Psychotria longipes
VFIP

SEQ ID NO: 3042 - protein, 4 aa, Viola baoshanensis
VYLP

SEQ ID NO: 3043 - protein, 4 aa, Viola baoshanensis
VWIP

SEQ ID NO: 3044 - protein, 4 aa, Viola baoshanensis
VLIP

SEQ ID NO: 3045 - protein, 4 aa, Viola baoshanensis
YTFP

SEQ ID NO: 3046 - protein, 4 aa, Viola baoshanensis
VWIP

SEQ ID NO: 3047 - protein, 4 aa, Viola baoshanensis
VWIP

SEQ ID NO: 3048 - protein, 4 aa, Viola baoshanensis
VWIP

SEQ ID NO: 3049 - protein, 8 aa, Viola baoshanensis
VIERTRAW

SEQ ID NO: 3050 - protein, 4 aa, Viola baoshanensis
VYLP

SEQ ID NO: 3051 - protein, 4 aa, Viola baoshanensis
VWIP

SEQ ID NO: 3052 - protein, 4 aa, Viola baoshanensis
VYIP

SEQ ID NO: 3053 - protein, 4 aa, Viola baoshanensis
VYIP

SEQ ID NO: 3054 - protein, 4 aa, Viola baoshanensis
VWIP

SEQ ID NO: 3055 - protein, 4 aa, Viola baoshanensis
VWIP

SEQ ID NO: 3056 - protein, 4 aa, Viola baoshanensis
VWIP

SEQ ID NO: 3057 - protein, 4 aa, Viola baoshanensis
VWIP

SEQ ID NO: 3058 - protein, 4 aa, Viola baoshanensis
AFIP

SEQ ID NO: 3059 - protein, 4 aa, Viola baoshanensis
VWIP

SEQ ID NO: 3060 - protein, 4 aa, Viola baoshanensis
VWIP

SEQ ID NO: 3061 - protein, 4 aa, Viola baoshanensis
VWIP

SEQ ID NO: 3062 - protein, 4 aa, Viola baoshanensis
VWIP

SEQ ID NO: 3063 - protein, 4 aa, Viola baoshanensis
VFIP

SEQ ID NO: 3064 - protein, 4 aa, Leonia cymosa
YVLP

SEQ ID NO: 3065 - protein, 4 aa, Leonia cymosa
VFIP

SEQ ID NO: 3066 - protein, 4 aa, Leonia cymosa
VFIP

SEQ ID NO: 3067 - protein, 4 aa, Hedyotis centranthoides
HYIP

SEQ ID NO: 3068 - protein, 4 aa, Hedyotis terminalis
HYIP

SEQ ID NO: 3069 - protein, 4 aa, Oldenlandia affinis
FVLG

SEQ ID NO: 3070 - protein, 4 aa, Oldenlandia affinis
VYIP

SEQ ID NO: 3071 - protein, 4 aa, Oldenlandia affinis
VYIP

SEQ ID NO: 3072 - protein, 4 aa, Melicytus ramiflorus
VYIP

SEQ ID NO: 3073 - protein, 4 aa, Melicytus ramiflorus
VFIP

SEQ ID NO: 3074 - protein, 4 aa, Melicytus ramiflorus
VWIP

SEQ ID NO: 3075 - protein, 5 aa, Viola hederacea
AMISF

SEQ ID NO: 3076 - protein, 4 aa, Viola biflora
VWIP

SEQ ID NO: 3077 - protein, 4 aa, Viola biflora
VWIP

SEQ ID NO: 3078 - protein, 4 aa, Viola tricolor
VWIP

SEQ ID NO: 3079 - protein, 4 aa, Hybathus floribundus E
VYIP

SEQ ID NO: 3080 - protein, 4 aa, Hybathus floribundus E
VYLP

SEQ ID NO: 3081 - protein, 4 aa, Hybathus floribundus E
IFFP

SEQ ID NO: 3082 - protein, 5 aa, Psychotria suterella
IWDKT

SEQ ID NO: 3083 - protein, 4 aa, Chassalia parvifolia
VFIP

SEQ ID NO: 3084 - protein, 4 aa, Viola baoshanensis
VFIP

SEQ ID NO: 3085 - protein, 4 aa, Viola baoshanensis
TLGT

SEQ ID NO: 3086 - protein, 4 aa, Viola baoshanensis
VGGT

SEQ ID NO: 3087 - protein, 4 aa, Viola baoshanensis
VGGT

SEQ ID NO: 3088 - protein, 4 aa, Viola hederacea
VYIP

SEQ ID NO: 3089 - protein, 4 aa, Viola hederacea
FGGT

SEQ ID NO: 3090 - protein, 4 aa, Viola odorata
VWIP

SEQ ID NO: 3091 - protein, 4 aa, Viola odorata
VGGT

SEQ ID NO: 3092 - protein, 4 aa, Viola odorata
FTGK

SEQ ID NO: 3093 - protein, 4 aa, Viola odorata
FTGK

SEQ ID NO: 3094 - protein, 4 aa, Viola odorata
VWIP

SEQ ID NO: 3095 - protein, 4 aa, Viola odorata
VTGS

SEQ ID NO: 3096 - protein, 4 aa, Viola odorata
VGGT

SEQ ID NO: 3097 - protein, 4 aa, Viola odorata
FGGT

SEQ ID NO: 3098 - protein, 4 aa, Viola odorata
FGGT

SEQ ID NO: 3099 - protein, 4 aa, Viola odorata
VWIP

SEQ ID NO: 3100 - protein, 4 aa, Viola odorata
VWIP

SEQ ID NO: 3101 - protein, 4 aa, Leonia cymosa
VFIP

SEQ ID NO: 3102 - protein, 4 aa, Oldenlandia affinis
VGGT

SEQ ID NO: 3103 - protein, 4 aa, Oldenlandia affinis
FGGT

SEQ ID NO: 3104 - protein, 4 aa, Oldenlandia affinis
FGGT

SEQ ID NO: 3105 - protein, 4 aa, Oldenlandia affinis
FGGT

SEQ ID NO: 3106 - protein, 4 aa, Oldenlandia affinis
FGGT

SEQ ID NO: 3107 - protein, 4 aa, Oldenlandia affinis
FGGT

SEQ ID NO: 3108 - protein, 4 aa, Oldenlandia affinis
FGGS

SEQ ID NO: 3109 - protein, 4 aa, Oldenlandia affinis
FGGT

SEQ ID NO: 3110 - protein, 4 aa, Oldenlandia affinis
FGGT

SEQ ID NO: 3111 - protein, 4 aa, Oldenlandia affinis
VGGT

SEQ ID NO: 3112 - protein, 4 aa, Oldenlandia affinis
FGGT

SEQ ID NO: 3113 - protein, 4 aa, Oldenlandia affinis
TLGT

SEQ ID NO: 3114 - protein, 4 aa, Oldenlandia affinis
VGGT

SEQ ID NO: 3115 - protein, 4 aa, Melicytus ramiflorus
VYIP

SEQ ID NO: 3116 - protein, 4 aa, Melicytus ramiflorus
VFIP

SEQ ID NO: 3117 - protein, 4 aa, Melicytus ramiflorus
LLGT

SEQ ID NO: 3118 - protein, 4 aa, Melicytus ramiflorus
VGNK

SEQ ID NO: 3119 - protein, 4 aa, Melicytus ramiflorus
VFIP

SEQ ID NO: 3120 - protein, 4 aa, Melicytus ramiflorus
VFIP

SEQ ID NO: 3121 - protein, 4 aa, Melicytus ramiflorus
VFIP

SEQ ID NO: 3122 - protein, 4 aa, Melicytus ramiflorus
VYIP

SEQ ID NO: 3123 - protein, 4 aa, Melicytus ramiflorus
VFIP

SEQ ID NO: 3124 - protein, 4 aa, Viola odorata
VGGT

SEQ ID NO: 3125 - protein, 4 aa, Viola odorata
FGGT

SEQ ID NO: 3126 - protein, 4 aa, Viola odorata
VGGT

SEQ ID NO: 3127 - protein, 4 aa, Viola odorata
VGGS

SEQ ID NO: 3128 - protein, 4 aa, Viola odorata
VGGT

SEQ ID NO: 3129 - protein, 4 aa, Viola odorata
TLGT

SEQ ID NO: 3130 - protein, 4 aa, Viola odorata
FGGT

SEQ ID NO: 3131 - protein, 4 aa, Viola odorata
FGGT

SEQ ID NO: 3132 - protein, 4 aa, Viola hederacea
FTGT

SEQ ID NO: 3133 - protein, 4 aa, Viola biflora
FGGT

SEQ ID NO: 3134 - protein, 4 aa, Viola biflora
FGGT

SEQ ID NO: 3135 - protein, 4 aa, Viola biflora
AFGS

SEQ ID NO: 3136 - protein, 4 aa, Viola biflora
FGGR

SEQ ID NO: 3137 - protein, 4 aa, Viola biflora
VFIP

SEQ ID NO: 3138 - protein, 4 aa, Viola biflora
VFIP

SEQ ID NO: 3139 - protein, 4 aa, Viola biflora
VYIP

SEQ ID NO: 3140 - protein, 4 aa, Viola biflora
VWIP

SEQ ID NO: 3141 - protein, 4 aa, Viola cotyledon
VYIP

SEQ ID NO: 3142 - protein, 4 aa, Viola cotyledon
VYIP

SEQ ID NO: 3143 - protein, 4 aa, Viola arvensis
VGGT

SEQ ID NO: 3144 - protein, 4 aa, Viola odorata
FTGK

SEQ ID NO: 3145 - protein, 4 aa, Viola odorata
TLGK

SEQ ID NO: 3146 - protein, 4 aa, Chassalia discolor
YVIP

SEQ ID NO: 3147 - protein, 4 aa, Hybanthus floribundus E
FIGK

SEQ ID NO: 3148 - protein, 4 aa, Hybanthus floribundus E
FIGK

SEQ ID NO: 3149 - protein, 4 aa, Viola odorata
FKGK

SEQ ID NO: 3150 - protein, 4 aa, Oldenlandia affinis
LLGT

SEQ ID NO: 3151 - protein, 4 aa, Oldenlandia affinis
VLGT

SEQ ID NO: 3152 - protein, 4 aa, Oldenlandia affinis
VLGT

SEQ ID NO: 3153 - protein, 4 aa, Melcytus ramiflorus
TLGE

SEQ ID NO: 3154 - protein, 5 aa, Palicourea condensata
RVIPV

SEQ ID NO: 3155 - protein, 4 aa, Viola yedoensis
FLGT

SEQ ID NO: 3156 - protein, 4 aa, Viola yedoensis
FLGT

SEQ ID NO: 3157 - protein, 4 aa, Viola yedoensis
FLGT

SEQ ID NO: 3158 - protein, 4 aa, Viola arvensis
FLGT

SEQ ID NO: 3159 - protein, 4 aa, Viola arvensis
FLGT

SEQ ID NO: 3160 - protein, 3 aa, Cladosporium fulvum
LGQ

SEQ ID NO: 3161 - protein, 3 aa, Aspergillus clavatus
GGP

SEQ ID NO: 3162 - protein, 3 aa, Aspergillus terreus
SGE

SEQ ID NO: 3163 - protein, 3 aa, Neosartorya fischeri
GGK

SEQ ID NO: 3164 - protein, 31 aa, Astyanax mexicanus
PFPLADHLNSTNHAIVQTLVNSVNTNIPKAC

SEQ ID NO: 3165 - protein, 31 aa, Astyanax mexicanus
PFPLSDHLNSTNHAIVQTLVNSVNSNIPRAC

SEQ ID NO: 3166 - protein, 31 aa, Astyanax mexicanus
PFPLADHLNSTNHAIVQTLVNSVNSNIPKAC

SEQ ID NO: 3167 - protein, 31 aa, Astyanax mexicanus
PFPLPDHLNATNHAVVQTLVNSVNSNIPKAC

SEQ ID NO: 3168 - protein, 31 aa, Astyanax mexicanus
PFPLADHLNSTNHAIVQTLVNSVNNNIPKAC

SEQ ID NO: 3169 - protein, 32 aa, Paracentrotus lividus
PFPLAEHLNTTNHAIVQTLVNSVNPALVPKAC

SEQ ID NO: 3170 - protein, 32 aa, Paracentrotus lividus
PFPLGERLNGTNHAIIQTLVNSIDSRAVPKVC

SEQ ID NO: 3171 - protein, 31 aa, Sparus aurata
PFPLADHLNSTNHAIVQTLVNSVNSNIPRAC

SEQ ID NO: 3172 - protein, 6 aa, Sparus aurata
NDESLE

SEQ ID NO: 3173 - protein, 6 aa, Homo sapiens
NDEGLE

SEQ ID NO: 3174 - protein, 32 aa, Homo sapiens
DFPLRSHLEPTNHAIIQTLMNSMDPGSTPPSC

SEQ ID NO: 3175 - protein, 32 aa, Homo sapiens
EFPLRSHLEPTNHAVIQTLMNSMDPESTPPTC

SEQ ID NO: 3176 - protein, 32 aa, Homo sapiens
AFPLNSYMNATNHAIVQTLVHFINPDTVPKPC

SEQ ID NO: 3177 - protein, 31 aa, Paralabidochromis chilotes; identical to SEQ ID NO: 3168

SEQ ID NO: 3178 - protein, 6 aa, Danio rerio
NDEMME

SEQ ID NO: 3179 - protein, 32 aa, Sus scrofa
AFPLNSYMNATNHAIVQTLVHFINPETVPKPC

SEQ ID NO: 3180 - protein, 32 aa, Sus scrofa; identical to SEQ ID NO: 3179

SEQ ID NO: 3181 - protein, 31 aa, Anas platyrhynchos
PFPLADHLNSTNHAIVQTLVNSVNSSIPKAC

SEQ ID NO: 3182 - protein, 31 aa, Anas platyrhynchos; identical to SEQ ID NO: 3181

SEQ ID NO: 3183 - protein, 6 aa, Oryzias latipes
NDEMLQ

SEQ ID NO: 3184 - protein, 31 aa, Bos Taurus
PFPLADHLNSTNHAIVQTLVNSVNSKIPKAC

SEQ ID NO: 3185 - protein, 31 aa, Capra hircus; identical to SEQ ID NO: 3181

SEQ ID NO: 3186 - protein, 31 aa, Bos Taurus; identical to SEQ ID NO: 3184

SEQ ID NO: 3187 - protein, 32 aa, Oryctolagus cuniculus
AFPLNSYMNATNHAIVQTLVHFIDPDTVPKPC

SEQ ID NO: 3188 - protein, 31 aa, Sus scrofa; identical to SEQ ID NO: 3181

SEQ ID NO: 3189 - protein, 32 aa, Nematostella vectensis
SFPLNANMNATNHAIVQTLVHLMNPKTVPKPC

SEQ ID NO: 3190 - protein, 31 aa, Nematostella vectensis
PYPIAKHLNATNHAIVQTIMNTVDSNVPNAC

SEQ ID NO: 3191 - protein, 32 aa, Nematostella vectensis
KYPIDNYLRPTNHATVQTIVNSLDPSIAPKAC

SEQ ID NO: 3192 - protein, 32 aa, Danio rerio
DFPLRSHLEPTNHAIIQTLMNSMNPSNMPPSC

SEQ ID NO: 3193 - protein, 32 aa, Homo sapiens; identical to SEQ ID NO: 3179

SEQ ID NO: 3194 - protein, 32 aa, Homo sapiens
SFPLNAHMNATNHAIVQTLVHLMFPDHVPKPC

SEQ ID NO: 3195 - protein, 32 aa, Sus scrofa; identical to SEQ ID NO: 3179

SEQ ID NO: 3196 - protein, 31 aa, Ovis aries; identical to SEQ ID NO: 3181

SEQ ID NO: 3197 - protein, 31 aa, Xenopus tropicalis; identical to SEQ ID NO: 3181

SEQ ID NO: 3198 - protein, 6 aa, Xenopus tropicalis
NDESLE

SEQ ID NO: 3199 - protein, 31 aa, Papio anubis; identical to SEQ ID NO: 3181

SEQ ID NO: 3200 - protein, 32 aa, Papio anubis; identical to SEQ ID NO: 3175

SEQ ID NO: 3201 - protein, 6 aa, Ovis aries
NDESLE

SEQ ID NO: 3202 - protein, 32 aa, Callithrix jacchus; identical to SEQ ID NO: 3175

SEQ ID NO: 3203 - protein, 6 aa, Sistrurus catenatus edwardsii
TDESLM

SEQ ID NO: 3204 - protein, 6 aa, Sistrurus catenatus edwardsii
TDESLM

SEQ ID NO: 3205 - protein, 32 aa, Culex quinquefasciatus
QFPIADHLNTTNHAIVQTLVNSISPSYAPKAC

SEQ ID NO: 3206 - protein, 32 aa, Homo sapiens; identical to SEQ ID NO: 3179

SEQ ID NO: 3207 - protein, 32 aa, Callicebus moloch; identical to SEQ ID NO: 3175

SEQ ID NO: 3208 - protein, 31 aa, Ambystoma mexicanum
PFPLADHMNSTNHAIVQTLVNSVNANIPKAC

SEQ ID NO: 3209 - protein, 6 aa, Ochotona curzoniae
NDESLE

SEQ ID NO: 3210 - protein, 6 aa, Ochotona curzoniae
NDESLE

SEQ ID NO: 3211 - protein, 31 aa, Rhinolophus ferrumequinum; identical to SEQ ID NO: 3181

SEQ ID NO: 3212 - protein, 32 aa, Rhinolophus ferrumequinum; identical to SEQ ID NO: 3175

SEQ ID NO: 3213 - protein, 32 aa, Ovis aries
SFPLNAHMNATNHAIVQTLVHLMNPEYVPKPC

SEQ ID NO: 3214 - protein, 32 aa, Capra hircus; identical to SEQ ID NO: 3213

SEQ ID NO: 3215 - protein, 32 aa, Mus musculus; identical to SEQ ID NO: 3213

SEQ ID NO: 3216 - protein, 32 aa, Homo sapiens; identical to SEQ ID NO: 3179

SEQ ID NO: 3217 - protein, 31 aa, Danio rerio; identical to SEQ ID NO: 3171

SEQ ID NO: 3218 - protein, 32 aa, Danio rerio; identical to SEQ ID NO: 3192

SEQ ID NO: 3219 - protein, 32 aa, Strongylocentrotus purpuratus; identical to SEQ ID NO: 3169

SEQ ID NO: 3220 - protein, 32 aa, Drosophila erecta
PFPLADHFNSTNHAVVQTLVNNMNPGKVPKAC

SEQ ID NO: 3221 - protein, 31 aa, Sorex araneus; identical to SEQ ID NO: 3181

SEQ ID NO: 3222 - protein, 32 aa, Sorex araneus; identical to SEQ ID NO: 3175

SEQ ID NO: 3223 - protein, 32 aa, Saccostrea kegaki
HWPYDDHMNVTNHAIVQDLVNSIDPRAAPKPC

SEQ ID NO: 3224 - protein, 32 aa, Homo sapiens; identical to SEQ ID NO: 3213

SEQ ID NO: 3225 - protein, 32 aa, Drosophilia grimshawi
PFPLADHLNSTNHAVVQTLVNNLNPGKVPKAC

SEQ ID NO: 3226 - protein, 32 aa, Drosophilia mojavensis
PFPLADHLNSTNHAVVQTLVNNINPGKVPKAC

SEQ ID NO: 3227 - protein, 32 aa, Drosophilia virilis
QFPLADHLNSTNHAVVQTLVNNLNPGKVPKAC

SEQ ID NO: 3228 - protein, 32 aa, Drosophilia willistoni
PFPLADHLNSTNHAVVQTLVNNIDPGKVPKAC

SEQ ID NO: 3229 - protein, 32 aa, Drosophilia yakuba; identical to SEQ ID NO: 3220

SEQ ID NO: 3230 - protein, 32 aa, Drosophilia simulans; identical to SEQ ID NO: 3220

SEQ ID NO: 3231 - protein, 6 aa, Sus scrofa
NDEGLE

SEQ ID NO: 3232 - protein, 32 aa, Xenopus tropicalis
EFPLRSHLEPTNHAVIQTLMNSMDPETTPPTC

SEQ ID NO: 3233 - protein, 6 aa, Homo sapiens
NDEGLE

SEQ ID NO: 3234 - protein, 6 aa, Rattus norvegicus
NDEALE

SEQ ID NO: 3235 - protein, 31 aa, Otolemur garnettii; identical to SEQ ID NO: 3181

SEQ ID NO: 3236 - protein, 32 aa, Otolemur garnettii; identical to SEQ ID NO: 3175

SEQ ID NO: 3237 - protein, 31 aa, Salmo salar; identical to SEQ ID NO: 3164

SEQ ID NO: 3238 - protein, 6 aa, Sus scrofa
GDENLH

SEQ ID NO: 3239 - protein, 32 aa, Branchiostoma floridae
PFPLNEHLNGTNHAVIQTLVNSLTPDSVPPAC

SEQ ID NO: 3240 - protein, 32 aa, Branchiostoma floridae; identical to SEQ ID NO: 3239

SEQ ID NO: 3241 - protein, 32 aa, Branchiostoma floridae
SFPLRSHLEPTNHAIVQTLVNSMNPRAVEKVC

SEQ ID NO: 3242 - protein, 32 aa, Branchiostoma floridae
PFPLADHLNSTNHAIVQTLVNSVNPLAVPKAC

SEQ ID NO: 3243 - protein, 32 aa, Branchiostoma floridae
PFPLNEKLNGTNHAIIQTLVNTVAPAAVPRPC

SEQ ID NO: 3244 - protein, 32 aa, Branchiostoma floridae; identical to SEQ ID NO: 3241

SEQ ID NO: 3245 - protein, 32 aa, Stylophora pistillata
PFHIADHLNTTNHAIVQTLMNSVNPNNVPPAC

SEQ ID NO: 3246 - protein, 32 aa, Acropora sp. DZ-2008
PFPIADHLNTTNHAIVQTLMNSVNPNNVPPAC

SEQ ID NO: 3247 - protein, 6 aa, Pseudocowpox virus
NDESLE

SEQ ID NO: 3248 - protein, 6 aa, Pseudocowpox virus
NDESLE

SEQ ID NO: 3249 - protein, 32 aa, Labidochromis caeruleus
DFPIRSHLEPTNHAIIQTLINSMDPESTPPTC

SEQ ID NO: 3250 - protein, 32 aa, Oryctolagus cuniculus; identical to SEQ ID NO: 3175

SEQ ID NO: 3251 - protein, 32 aa, Ixodes scapularis
PFPLPDHLNGTNHAIVQTLVNSMRAGGVPNAC

SEQ ID NO: 3252 - protein, 31 aa, Xenopus laevis; identical to SEQ ID NO: 3181

SEQ ID NO: 3253 - protein, 32 aa, Xenopus laevis
DFPLRSHLEPTNHAIIQTLMNSMNPGSTPPSC

SEQ ID NO: 3254 - protein, 31 aa, Xenopus laevis; identical to SEQ ID NO: 3164

SEQ ID NO: 3255 - protein, 6 aa, Danio rerio
NDEMME

SEQ ID NO: 3256 - protein, 31 aa, Salmo salar; identical to SEQ ID NO: 3164

SEQ ID NO: 3257 - protein, 31 aa, Gadus morhua; identical to SEQ ID NO: 3164

SEQ ID NO: 3258 - protein, 32 aa, Bombyx mori
PFPLADHLNGTNHAIVQTLVNSVDPALVPKAC

SEQ ID NO: 3259 - protein, 32 aa, Mus musculus; identical to SEQ ID NO: 3194

SEQ ID NO: 3260 - protein, 31 aa, Salmo salar; identical to SEQ ID NO: 3171

SEQ ID NO: 3261 - protein, 6 aa, Bitis arietans
SDESLT

SEQ ID NO: 3262 - protein, 6 aa, Agkistrodon piscivorus piscivorus
SDESLT

SEQ ID NO: 3263 - protein, 6 aa, Crotalus atrox
TDESLT

SEQ ID NO: 3264 - protein, 6 aa, Agkistrodon piscivorus piscivorus
NDEALE

SEQ ID NO: 3265 - protein, 6 aa, Vipera ammodytes ammodytes
NDEALE

SEQ ID NO: 3266 - protein, 6 aa, Protobothrops flavoviridis
SDESLT

SEQ ID NO: 3267 - protein, 6 aa, Protobothrops flavoviridis
NDEALE

SEQ ID NO: 3268 - protein, 6 aa, Vipera ammodytes ammodytes
TDESLK

SEQ ID NO: 3269 - protein, 6 aa, Daboia russelli russelli
TDESMK

SEQ ID NO: 3270 - protein, 6 aa, Osmerus mordax
NDEMLQ

SEQ ID NO: 3271 - protein, 6 aa, Anoplopoma fimbria
MDENLE

SEQ ID NO: 3272 - protein, 32 aa, Dasypus novemcinctus; identical to SEQ ID NO: 3175

SEQ ID NO: 3273 - protein, 31 aa, Myotis ricketti; identical to SEQ ID NO: 3184

SEQ ID NO: 3274 - protein, 31 aa, Danio rerio
PFPLADHLNSTNHAIVQTLVNSVNTNIPKWC

SEQ ID NO: 3275 - protein, 31 aa, Danio rerio
PFPLPDHLNSTNHAIVQTLVNSVNSNIPKAC

SEQ ID NO: 3276 - protein, 31 aa, Danio rerio
PFPLADHLNSTTNAMVQTLVNSVNSNIPRAC

SEQ ID NO: 3277 - protein, 31 aa, Dama dama; identical to SEQ ID NO: 3184

SEQ ID NO: 3278 - protein, 32 aa, Danio rerio
DFPIRSHLEPTNHAIIQTLMNSMDPRSTPPTC

SEQ ID NO: 3279 - protein, 6 aa, Xenopus laevis
NDESLE

SEQ ID NO: 3280 - protein, 6 aa, Xenopus laevis
NDESLE

SEQ ID NO: 3281 - protein, 31 aa, Oryctolagus cuniculus; identical to SEQ ID NO: 3184

SEQ ID NO: 3282 - protein, 31 aa, Oryctolagus cuniculus
PFPLADHFNSTNHAIVQTLVNSVNSSIPKAC

SEQ ID NO: 3283 - protein, 31 aa, Danio rerio; identical to SEQ ID NO: 3275

SEQ ID NO: 3284 - protein, 31 aa, Danio rerio; identical to SEQ ID NO: 3164

SEQ ID NO: 3285 - protein, 6 aa, Danio rerio
NDEALE

SEQ ID NO: 3286 - protein, 6 aa, Danio rerio
NDEALE

SEQ ID NO: 3287 - protein, 31 aa, Xenopus laevis
PFPLADHLNSTNHAIVQTLVNSVNASIPKAC

SEQ ID NO: 3288 - protein, 32 aa, Halocynthia roretzi
PFPLAEYMNATNHAIVQTLVNSVDPSLTPKPC

SEQ ID NO: 3289 - protein, 6 aa, Ovis aries
NDESLE

SEQ ID NO: 3290 - protein, 6 aa, Rattus norvegicus
NDEALE

SEQ ID NO: 3291 - protein, 31 aa, Danio rerio; identical to SEQ ID NO: 3275

SEQ ID NO: 3292 - protein, 32 aa, Gallus gallus
DFPLRSHLEPTNHAIIQTLMNSMDPESTPPSC

SEQ ID NO: 3293 - protein, 32 aa, Branchiostoma floridae; identical to SEQ ID NO: 3242

SEQ ID NO: 3294 - protein, 32 aa, Crassostrea gigas; identical to SEQ ID NO: 3223

SEQ ID NO: 3295 - protein, 32 aa, Drosophilia melanogaster; identical to SEQ ID NO: 3220

SEQ ID NO: 3296 - protein, 31 aa, Homo sapiens; identical to SEQ ID NO: 3184

SEQ ID NO: 3297 - protein, 31 aa, Homo sapiens; identical to SEQ ID NO: 3181

SEQ ID NO: 3298 - protein, 6 aa, Bos Taurus
NDESLE

SEQ ID NO: 3299 - protein, 6 aa, Bos Taurus
NDESLE

SEQ ID NO: 3300 - protein, 6 aa, Bos Taurus
NDEGLE

SEQ ID NO: 3301 - protein, 6 aa, Bos Taurus
NDEGLE

SEQ ID NO: 3302 - protein, 6 aa, Bos Taurus
NDEGLE

SEQ ID NO: 3303 - protein, 6 aa, Bos Taurus
NDEGLE

SEQ ID NO: 3304 - protein, 6 aa, Bos Taurus
NDEGLE

SEQ ID NO: 3305 - protein, 6 aa, Bos Taurus
NDEGLE

SEQ ID NO: 3306 - protein, 6 aa, Bos Taurus
NDEGLE

SEQ ID NO: 3307 - protein, 6 aa, Bos Taurus
NDEGLE

SEQ ID NO: 3308 - protein, 6 aa, Bos Taurus
NDEGLE

SEQ ID NO: 3309 - protein, 6 aa, Bos Taurus
NDEGLE

SEQ ID NO: 3310 - protein, 6 aa, Rattus norvegicus
NDEALE

SEQ ID NO: 3311 - protein, 6 aa, Rattus norvegicus
NDEALE

SEQ ID NO: 3312 - protein, 6 aa, Rattus norvegicus
NDEALE

SEQ ID NO: 3313 - protein, 6 aa, Rattus norvegicus
NDEALE

SEQ ID NO: 3314 - protein, 32 aa, Homo sapiens; identical to SEQ ID NO: 3179

SEQ ID NO: 3315 - protein, 32 aa, Mus musculus; identical to SEQ ID NO: 3213

SEQ ID NO: 3316 - protein, 31 aa, Mus musculus; identical to SEQ ID NO: 3184

SEQ ID NO: 3317 - protein, 31 aa, Mus musculus; identical to SEQ ID NO: 3181

SEQ ID NO: 3318 - protein, 32 aa, Homo sapiens; identical to SEQ ID NO: 3194

SEQ ID NO: 3319 - protein, 32 aa, Homo sapiens; identical to SEQ ID NO: 3213

SEQ ID NO: 3320 - protein, 32 aa, Mus musculus; identical to SEQ ID NO: 3176

SEQ ID NO: 3321 - protein, 31 aa, Xenopus laevis; identical to SEQ ID NO: 3164

SEQ ID NO: 3322 - protein, 6 aa, Cavia porcellus
NDESLE

SEQ ID NO: 3323 - protein, 31 aa, Xenopus laevis; identical to SEQ ID NO: 3164

SEQ ID NO: 3324 - protein, 31 aa, Xenopus laevis; identical to SEQ ID NO: 3181

SEQ ID NO: 3325 - protein, 32 aa, Danio rerio
PFPLSESLNGTNHAILQTLVHSFDPKGTPQPC

SEQ ID NO: 3326 - protein, 32 aa, Homo sapiens; identical to SEQ ID NO: 3175

SEQ ID NO: 3327 - protein, 32 aa, Mus musculus; identical to SEQ ID NO: 3175

SEQ ID NO: 3328 - protein, 32 aa, Mus musculus; identical to SEQ ID NO: 3174

SEQ ID NO: 3329 - protein, 32 aa, Mus musculus
DFPLRSHLEPTNHAIIQTLLNSMAPDAAPASC

SEQ ID NO: 3330 - protein, 32 aa, Mus musculus; identical to SEQ ID NO: 3329

SEQ ID NO: 3331 - protein, 32 aa, Strongylocentrotus purpuratus
AFPLNGHANATNHAIVQTLVHHMSPSHVPQPC

SEQ ID NO: 3332 - protein, 32 aa, Strongylocentrotus purpuratus
PFPLGERLNGTNHAIIQTLVNSIDNRAVPKVC

SEQ ID NO: 3333 - protein, 31 aa, Rattus norvegicus; identical to SEQ ID NO: 3184

SEQ ID NO: 3334 - protein, 32 aa, Mus musculus; identical to SEQ ID NO: 3194

SEQ ID NO: 3335 - protein, 6 aa, Sus scrofa
NDEGLE

SEQ ID NO: 3336 - protein, 6 aa, Homo sapiens
GDENLH

SEQ ID NO: 3337 - protein, 6 aa, Homo sapiens
GDENLH

SEQ ID NO: 3338 - protein, 6 aa, Homo sapiens
GDENLH

SEQ ID NO: 3339 - protein, 6 aa, Mus musculus
GDEGLH

SEQ ID NO: 3340 - protein, 6 aa, Ovis aries
NDESLE

SEQ ID NO: 3341 - protein, 32 aa, Bos taurus; identical to SEQ ID NO: 3174

SEQ ID NO: 3342 - protein, 6 aa, Protobothrops flavoviridis
NDEALE

SEQ ID NO: 3343 - protein, 6 aa, Protobothrops flavoviridis
NDEALE

SEQ ID NO: 3344 - protein, 6 aa, Protobothrops flavoviridis
NDEALE

SEQ ID NO: 3345 - protein, 6 aa, Daboia russelli russelli
TDESMK

SEQ ID NO: 3346 - protein, 6 aa, Protobothrops flavoviridis
SDESLT

SEQ ID NO: 3347 - protein, 6 aa, Vipera ammodytes ammodytes
TDESLK

SEQ ID NO: 3348 - protein, 6 aa, Gallus gallus
GDEGLE

SEQ ID NO: 3349 - protein, 6 aa, Coturnix coturnix japonica
GDEGLE

SEQ ID NO: 3350 - protein, 6 aa, Coturnix coturnix japonica
GDEGLE

SEQ ID NO: 3351 - protein, 6 aa, Coturnix coturnix japonica
GDEGLE

SEQ ID NO: 3352 - protein, 6 aa, Coturnix coturnix japonica
GDEGLE

SEQ ID NO: 3353 - protein, 6 aa, Macrovipera lebetina
TDESLK

SEQ ID NO: 3354 - protein, 6 aa, Bitis gabonica
NDEALE

SEQ ID NO: 3355 - protein, 6 aa, Viper aspis aspis
TDESLK

SEQ ID NO: 3356 - protein, 32 aa, Danio rerio
DFPLRSHLEPTNHAIIQTLMNSMDPNSTPPSC

SEQ ID NO: 3357 - protein, 32 aa, Gallus gallus; identical to SEQ ID NO: 3194

SEQ ID NO: 3358 - protein, 32 aa, Drosophilia simulans; identical to SEQ ID NO: 3220

SEQ ID NO: 3359 - protein, 32 aa, Drosophilia virilis; identical to SEQ ID NO: 3227

SEQ ID NO: 3360 - protein, 6 aa, Mus musculus
NDEALE

SEQ ID NO: 3361 - protein, 6 aa, Mus musculus
NDEALE

SEQ ID NO: 3362 - protein, 6 aa, Mus musculus
NDEALE

SEQ ID NO: 3363 - protein, 6 aa, Mus musculus
NDEALE

SEQ ID NO: 3364 - protein, 32 aa, Rattus norvegicus; identical to SEQ ID NO: 3213

SEQ ID NO: 3365 - protein, 31 aa, Rattus norvegicus; identical to SEQ ID NO: 3181

SEQ ID NO: 3366 - protein, 6 aa, Xenopus tropicalis
NDESLE

SEQ ID NO: 3367 - protein, 31 aa, Nematostella vectensis; identical to SEQ ID NO: 3190

SEQ ID NO: 3368 - protein, 6 aa, Danio rerio
NDEMME

SEQ ID NO: 3369 - protein, 32 aa, Aedes aegypti
QFPIADHLNTTNHAIVQTLVNSINPSLAPKAC

SEQ ID NO: 3370 - protein, 6 aa, Pantholops hodgsonii
NDESLE

SEQ ID NO: 3371 - protein, 6 aa, Danio rerio
NDEMME

SEQ ID NO: 3372 - protein, 6 aa, Danio rerio
NDEMME

SEQ ID NO: 3373 - protein, 32 aa, Saccoglossus kowalevskii
SFPLNAHMNATNHAIVQTLVHLMDPEAVPKPC

SEQ ID NO: 3374 - protein, 32 aa, Saccoglossus kowalevskii
PFPIAEHLNSTNHAIVQTLVNSVSPDSVPKAC

SEQ ID NO: 3375 - protein, 32 aa, Drosophila yakuba; identical to SEQ ID NO: 3220

SEQ ID NO: 3376 - protein, 32 aa, Drosophila teissieri; identical to SEQ ID NO: 3220

SEQ ID NO: 3377 - protein, 32 aa, Drosophila orena; identical to SEQ ID NO: 3220

SEQ ID NO: 3378 - protein, 32 aa, Junonia coenia
PFPLSDHLNGTNHAIVQTLVNSVNPAAVPKAC

SEQ ID NO: 3379 - protein, 32 aa, Schistocerca Americana
PFPLSAHMNSTNHAVVQTLMNSMNPGLVPKAC

SEQ ID NO: 3380 - protein, 32 aa, Nematostella vectensis; identical to SEQ ID NO: 3189

SEQ ID NO: 3381 - protein, 31 aa, Dama dama; identical to SEQ ID NO: 3181

SEQ ID NO: 3382 - protein, 31 aa, Bos taurus; identical to SEQ ID NO: 3181

SEQ ID NO: 3383 - protein, 31 aa, Eleutherodactylus coqui; identical to SEQ ID NO: 3181

SEQ ID NO: 3384 - protein, 32 aa, Homo sapiens; identical to SEQ ID NO: 3175

SEQ ID NO: 3385 - protein, 31 aa, Didelphis albiventris
PFPLTDHLNSTNHAIVQTLVNSVNSSIPRAC

SEQ ID NO: 3386 - protein, 32 aa, Platynereis dumerilii
GFPLPEYINATNHAIVQTLVHSVNPEAVPRPC

SEQ ID NO: 3387 - protein, 32 aa, Nematostella vectensis; identical to SEQ ID NO: 3191

SEQ ID NO: 3388 - protein, 6 aa, Protobothrops mucrosquamatus
SDESLT

SEQ ID NO: 3389 - protein, 6 aa, Anguilla japonica
NDEALE

SEQ ID NO: 3390 - protein, 32 aa, Amphiura filiformis
PFPLADHLNSTNHAIVQTLVNSVNPQLVPKAC

SEQ ID NO: 3391 - protein, 32 aa, Equus caballus; identical to SEQ ID NO: 3175

SEQ ID NO: 3392 - protein, 31 aa, Mus musculus; identical to SEQ ID NO: 3181

SEQ ID NO: 3393 - protein, 32 aa, Mus musculus; identical to SEQ ID NO: 3213

SEQ ID NO: 3394 - protein, 31 aa, Mus musculus
PFPLADHLNSTNHAIVQTLVNSVNSQIPKAC

SEQ ID NO: 3395 - protein, 32 aa, Mus musculus; identical to SEQ ID NO: 3194

SEQ ID NO: 3396 - protein, 32 aa, Mus musculus; identical to SEQ ID NO: 3194

SEQ ID NO: 3397 - protein, 31 aa, Mus musculus; identical to SEQ ID NO: 3184

SEQ ID NO: 3398 - protein, 32 aa, Ciona intestinalis
PFPLSGKLNGTNHAMLMTMMNSVDPSNTPMPC

SEQ ID NO: 3399 - protein, 32 aa, Homo sapiens; identical to SEQ ID NO: 3213

SEQ ID NO: 3400 - protein, 31 aa, Bos taurus; identical to SEQ ID NO: 3181

SEQ ID NO: 3401 - protein, 32 aa, Macaca fascicularis; identical to SEQ ID NO: 3194

SEQ ID NO: 3402 - protein, 6 aa, Tetraodon nigroviridis
GDEKLE

SEQ ID NO: 3403 - protein, 31 aa, Tetraodon nigroviridis; identical to SEQ ID NO: 3166

SEQ ID NO: 3404 - protein, 32 aa, Tetraodon nigroviridis
AFPLNAHMNATNHAIVQTLVHLMFPDNVPKPC

SEQ ID NO: 3405 - protein, 6 aa, Tetraodon nigroviridis
GDEHLE

SEQ ID NO: 3406 - protein, 32 aa, Tetraodon nigroviridis; identical to SEQ ID NO: 3356

SEQ ID NO: 3407 - protein, 6 aa, Tetraodon nigroviridis
NDEGKE

SEQ ID NO: 3408 - protein, 32 aa, Tetraodon nigroviridis
PFPLSDSLNGTNHAILQTLVHSLDPHGTPQPC

SEQ ID NO: 3409 - protein, 6 aa, Orf virus
NDESLE

SEQ ID NO: 3410 - protein, 32 aa, Homo sapiens; identical to SEQ ID NO: 3213

SEQ ID NO: 3411 - protein, 31 aa, Homo sapiens; identical to SEQ ID NO: 3181

SEQ ID NO: 3412 - protein, 6 aa, Homo sapiens
GDENLH

SEQ ID NO: 3413 - protein, 6 aa, Gallus gallus
GDEGLE

SEQ ID NO: 3414 - protein, 6 aa, Rattus norvegicus
NDEALE

SEQ ID NO: 3415 - protein, 6 aa, Mus musculus
GDEGLH

SEQ ID NO: 3416 - protein, 31 aa, Xenopus laevis; identical to SEQ ID NO: 3164

SEQ ID NO: 3417 - protein, 32 aa, Amphiura filiformis
PFPLNDRLNGTNHAIIQTLVNSMDPSSVPKVC

SEQ ID NO: 3418 - protein, 6 aa, Homo sapiens
NDEGLE

SEQ ID NO: 3419 - protein, 31 aa, Bos taurus; identical to SEQ ID NO: 3181

SEQ ID NO: 3420 - protein, 6 aa, Danio rerio
NDEMME

SEQ ID NO: 3421 - protein, 32 aa, Danio rerio; identical to SEQ ID NO: 3325

SEQ ID NO: 3422 - protein, 32 aa, Nematostella vectensis; identical to SEQ ID NO: 3191

SEQ ID NO: 3423 - protein, 6 aa, Rattus norvegicus
GDEGLH

SEQ ID NO: 3424 - protein, 6 aa, Rattus norvegicus
NDEALE

SEQ ID NO: 3425 - protein, 32 aa, Xenopus tropicalis
PYPLTEMLRGTNHAVLQTLVHSVEPESTPLPC

SEQ ID NO: 3426 - protein, 32 aa, Xenopus laevis; identical to SEQ ID NO: 3232

SEQ ID NO: 3427 - protein, 31 aa, Rattus norvegicus; identical to SEQ ID NO: 3181

SEQ ID NO: 3428 - protein, 31 aa, Trachemys scripta
PFPLADHLNTTNHAIVQTLVNSVNSKIPKAC

SEQ ID NO: 3429 - protein, 6 aa, Oncohynchus mykiss
NDEALE

SEQ ID NO: 3430 - protein, 6 aa, Oncorhynchus mykiss
NDEALE

SEQ ID NO: 3431 - protein, 32 aa, Rattus norvegicus; identical to SEQ ID NO: 3174

SEQ ID NO: 3432 - protein, 31 aa, Petromyzon marinus
PFPLADHLNSTNHAIVQTLVNSVNASIPRAC

SEQ ID NO: 3433 - protein, 31 aa, Petromyzon marinus; identical to SEQ ID NO: 3432

SEQ ID NO: 3434 - protein, 31 aa, Petromyzon marinus
HFPLPQHLNSTNHAIVQTLVNSVNPEVPRAC

SEQ ID NO: 3435 - protein, 6 aa, Bothrops erythromelas
TDESLE

SEQ ID NO: 3436 - protein, 32 aa, Homo sapiens; identical to SEQ ID NO: 3174

SEQ ID NO: 3437 - protein, 32 aa, Xenopus tropicalis; identical to SEQ ID NO: 3176

SEQ ID NO: 3438 - protein, 31 aa, Xenopus laevis; identical to SEQ ID NO: 3287

SEQ ID NO: 3439 - protein, 6 aa, Bovine popular stomatitis virus
NDESLE

SEQ ID NO: 3440 - protein, 31 aa, Equus caballus; identical to SEQ ID NO: 3181

SEQ ID NO: 3441 - protein, 6 aa, Bovine popular stomatitis virus
NDESLE

SEQ ID NO: 3442 - protein, 6 aa, Homo sapiens
NDEGLE

SEQ ID NO: 3443 - protein, 31 aa, Gallus gallus; identical to SEQ ID NO: 3184

SEQ ID NO: 3444 - protein, 6 aa, Mus musculus
NDEALE

SEQ ID NO: 3445 - protein, 31 aa, Paralichthys olivaceus; identical to SEQ ID NO: 3171

SEQ ID NO: 3446 - protein, 32 aa, Homo sapiens; identical to SEQ ID NO: 3329

SEQ ID NO: 3447 - protein, 32 aa, Athalia rosae
PFPLADHLNSTNHAIVQTLVYSTNPNIVPKAC

SEQ ID NO: 3448 - protein, 6 aa, Orv virus strain D1701
NDESLE

SEQ ID NO: 3449 - protein, 31 aa, Tanganicodus irsacae; identical to SEQ ID NO: 3168

SEQ ID NO: 3450 - protein, 31 aa, Ophthalmotilapia nasuta; identical to SEQ ID NO: 3168

SEQ ID NO: 3451 - protein, 31 aa, Haplotaxodon microlepis; identical to SEQ ID NO: 3168

SEQ ID NO: 3452 - protein, 31 aa, Gnathochromis permaxillaris; identical to SEQ ID NO: 3168

SEQ ID NO: 3453 - protein, 32 aa, Anopheles gambiae
RFPIADHLNTTNHAIVQTLVNSYNPTLAPKAC

SEQ ID NO: 3454 - protein, 32 aa, Danio rerio
SFPLNAHMNATNHAIVQTLVHLMFPDNVPKPC

SEQ ID NO: 3455 - protein, 32 aa, Homo sapiens; identical to SEQ ID NO: 3329

SEQ ID NO: 3456 - protein, 31 aa, Tetraodon nigroviridis; identical to SEQ ID NO: 3171

SEQ ID NO: 3457 - protein, 31 aa, Takifugu rubripes; identical to SEQ ID NO: 3171

SEQ ID NO: 3458 - protein, 31 aa, Rattus norvegicus; identical to SEQ ID NO: 3181

SEQ ID NO: 3459 - protein, 6 aa, Oryctolagus cuniculus
NDESLE

SEQ ID NO: 3460 - protein, 32 aa, Parasteatoda tepidariorum
PFPLPDHLNTTNHAIVQTLVNSANPAAVPRAC

SEQ ID NO: 3461 - protein, 32 aa, Ilyanassa obsolete
NFPLAQHLNSTNHAIVQTLVNSVDPTAVSKAC

SEQ ID NO: 3462 - protein, 32 aa, Mus musculus; identical to SEQ ID NO: 3213

SEQ ID NO: 3463 - protein, 32 aa, Mus musculus; identical to SEQ ID NO: 3175

SEQ ID NO: 3464 - protein, 32 aa, Mus musculus; identical to SEQ ID NO: 3194

SEQ ID NO: 3465 - protein, 6 aa, Mustela vison
NDEGLE

SEQ ID NO: 3466 - protein, 6 aa, Ovis aries
SDETMH

SEQ ID NO: 3467 - protein, 32 aa, Stichopus japonicas
PYPMPEHLNPTNHAIVQTIVHSADPSSVPKAC

SEQ ID NO: 3468 - protein, 31 aa, Boulengerochromis microlepis; identical to SEQ ID NO: 3168

SEQ ID NO: 3469 - protein, 31 aa, Talapia rendalli; identical to SEQ ID NO: 3168

SEQ ID NO: 3470 - protein, 31 aa, Tropheus duboisi; identical to SEQ ID NO: 3168

SEQ ID NO: 3471 - protein, 31 aa, Steatocranus casuarius; identical to SEQ ID NO: 3168

SEQ ID NO: 3472 - protein, 31 aa, Oreochromis niloticus; identical to SEQ ID NO: 3168

SEQ ID NO: 3473 - protein, 31 aa, Labidochromis caeruleus; identical to SEQ ID NO: 3168

SEQ ID NO: 3474 - protein, 31 aa, Julidochromis transcriptus; identical to SEQ ID NO: 3168

SEQ ID NO: 3475 - protein, 31 aa, Pundamilia nyererei; identical to SEQ ID NO: 3168

SEQ ID NO: 3476 - protein, 31 aa, Haplochromis burtoni; identical to SEQ ID NO: 3168

SEQ ID NO: 3477 - protein, 31 aa, Cyprichromis leptosome; identical to SEQ ID NO: 3168

SEQ ID NO: 3478 - protein, 31 aa, Ctenochromis horei; identical to SEQ ID NO: 3168

SEQ ID NO: 3479 - protein, 31 aa, Astatoreochromis alluaudi; identical to SEQ ID NO: 3168

SEQ ID NO: 3480 - protein, 31 aa, Suncus murinus; identical to SEQ ID NO: 3181

SEQ ID NO: 3481 - protein, 32 aa, Patella vulgata
PFPMGQHLNSTHHAVMQTLVHSVDPTAVPKAC

SEQ ID NO: 3482 - protein, 32 aa, Acropora millepora; identical to SEQ ID NO: 3246

SEQ ID NO: 3483 - protein, 32 aa, Hemicentrotus pulcherrimus
AFPLNGHANATNHAIVQTLVHHMSPSTVPQPC

SEQ ID NO: 3484 - protein, 6 aa, Equus caballus
NDEGLE

SEQ ID NO: 3485 - protein, 6 aa, Sus scrofa
NDEGLE

SEQ ID NO: 3486 - protein, 6 aa, Sus scrofa
NDEGLE

SEQ ID NO: 3487 - protein, 32 aa, Archaster typicus
PFPLVDHLNATNHAIVQTLVNSASPQLAPKAC

SEQ ID NO: 3488 - protein, 32 aa, Gallus gallus
PFPLTAELNSTNHAILQTMVHSLDPEGTPQPC

SEQ ID NO: 3489 - protein, 31 aa, Gallus gallus; identical to SEQ ID NO: 3184

SEQ ID NO: 3490 - protein, 31 aa, Gallus gallus; identical to SEQ ID NO: 3181

SEQ ID NO: 3491 - protein, 6 aa, Bothrops jararaca
TDESLE

SEQ ID NO: 3492 - protein, 6 aa, Bothrops insularis
TDESLK

SEQ ID NO: 3493 - protein, 31 aa, Lampetra japonica; identical to SEQ ID NO: 3432

SEQ ID NO: 3494 - protein, 31 aa, Lampetra japonica; identical to SEQ ID NO: 3434

SEQ ID NO: 3495 - protein, 31 aa, Xenopus tropicalis; identical to SEQ ID NO: 3181

SEQ ID NO: 3496 - protein, 31 aa, Xenopus tropicalis
PFPLADHLNSTNHAIVQTLVNNVNPNIPKAC

SEQ ID NO: 3497 - protein, 32 aa, Gallus gallus; identical to SEQ ID NO: 3179

SEQ ID NO: 3498 - protein, 31 aa, Xenopus laevis; identical to SEQ ID NO: 3287

SEQ ID NO: 3499 - protein, 6 aa, Felis catus
NDEGLE

SEQ ID NO: 3500 - protein, 6 aa, Macaca fascicularis
NDEGLE

SEQ ID NO: 3501 - protein, 32 aa, Schistocerca gregaria; identical to SEQ ID NO: 3379

SEQ ID NO: 3502 - protein, 32 aa, Gallus Gallus; identical to SEQ ID NO: 3488

SEQ ID NO: 3503 - protein, 6 aa, Mesocricetus auratus
SDEALE

SEQ ID NO: 3504 - protein, 6 aa, Macaca mulatta
NDEGLE

SEQ ID NO: 3505 - protein, 32 aa, Chlorocebus aethiops; identical to SEQ ID NO: 3329

SEQ ID NO: 3506 - protein, 32 aa, Macaca fascicularis; identical to SEQ ID NO: 3329

SEQ ID NO: 3507 - protein, 32 aa, Xenopus laevis; identical to SEQ ID NO: 3292

SEQ ID NO: 3508 - protein, 6 aa, Mesocricetus auratus
SDEALE

SEQ ID NO: 3509 - protein, 6 aa, Callithrix jacchus
NDEGLE

SEQ ID NO: 3510 - protein, 6 aa, Equus caballus
NDEGLE

SEQ ID NO: 3511 - protein, 32 aa, Gallus gallus; identical to SEQ ID NO: 3179

SEQ ID NO: 3512 - protein, 6 aa, Canis familiaris
NDEGLE

SEQ ID NO: 3513 - protein, 6 aa, Canis familiaris
NDEGLE

SEQ ID NO: 3514 - protein, 6 aa, Canis familiaris
NDEGLE

SEQ ID NO: 3515 - protein, 6 aa, Ovis aries
NDESLE

SEQ ID NO: 3516 - protein, 31 aa, Canis familiaris; identical to SEQ ID NO: 3181

SEQ ID NO: 3517 - protein, 32 aa, Danio rerio
VFPLNSYMNATNHAIVQTLVHFINPETVPKPC

SEQ ID NO: 3518 - protein, 6 aa, Spalax ehrenbergi
NDEALE

SEQ ID NO: 3519 - protein, 32 aa, Branchiostoma belcheri; identical to SEQ ID NO: 3242

SEQ ID NO: 3520 - protein, 32 aa, Ptychodera flava
PFPLADHLNSTNHAIVQTLVHSVKASAVPQAC

SEQ ID NO: 3521 - protein, 32 aa, Danio rerio; identical to SEQ ID NO: 3292

SEQ ID NO: 3522 - protein, 32 aa, Gallus gallus; identical to SEQ ID NO: 3175

SEQ ID NO: 3523 - protein, 32 aa, Xenopus laevis; identical to SEQ ID NO: 3253

SEQ ID NO: 3524 - protein, 6 aa, Bos taurus
SDESMH

SEQ ID NO: 3525 - protein, 32 aa, Lytechinus variegatus; identical to SEQ ID NO: 3169

SEQ ID NO: 3526 - protein, 32 aa, Strongylocentrotus purpuratus; identical to SEQ ID NO: 3169

SEQ ID NO: 3527 - protein, 32 aa, Tripneustes gratilla; identical to SEQ ID NO: 3169

SEQ ID NO: 3528 - protein, 32 aa, Xenopus laevis; identical to SEQ ID NO: 3176

SEQ ID NO: 3529 - protein, 32 aa, Xenopus laevis
PYPLTEMLRGTNHAVLQTLVHSVEPENTPLPC

SEQ ID NO: 3530 - protein, 6 aa, Orf virus
NDESLE

SEQ ID NO: 3531 - protein, 5 aa, Solanum lycopersicum
IGITL

SEQ ID NO: 3532 - protein, 5 aa, Solanum lycopersicum
SGGTF

SEQ ID NO: 3533 - protein, 5 aa, Solanum tuberosum
SGAWF

SEQ ID NO: 3534 - protein, 5 aa, Solanum tuberosum
LGITL

SEQ ID NO: 3535 - protein, 5 aa, Solanum tuberosum
FGITL

SEQ ID NO: 3536 - protein, 5 aa, Solanum tuberosum
IGITF

SEQ ID NO: 3537 - protein, 5 aa, Solanum tuberosum
FGITL

SEQ ID NO: 3538 - protein, 5 aa, Solanum tuberosum
FGLTL

SEQ ID NO: 3539 - protein, 5 aa, Solanum tuberosum
FGITL

SEQ ID NO: 3540 - protein, 5 aa, Solanum tuberosum
FGITL

SEQ ID NO: 3541 - protein, 5 aa, Solanum brevidens
IGITF

SEQ ID NO: 3542 - protein, 5 aa, Solanum tuberosum
SGAWF

SEQ ID NO: 3543 - protein, 5 aa, Hyoscyamus niger
SDGWL

SEQ ID NO: 3544 - protein, 2 aa, Petunia hybrid
VA

SEQ ID NO: 3545 - protein, 2 aa, Petunia hybrid
VK

SEQ ID NO: 3546 - protein, 4 aa, Pisum sativum
GTSA

SEQ ID NO: 3547 - protein, 4 aa, Pisum sativum
GSSA

SEQ ID NO: 3548 - protein, 4 aa, Pisum sativum
GSPL

SEQ ID NO: 3549 - protein, 4 aa, Pisum sativum
GTSA

SEQ ID NO: 3550 - protein, 4 aa, Pisum sativum
GSSA

SEQ ID NO: 3551 - protein, 4 aa, Pisum sativum
GTSA

SEQ ID NO: 3552 - protein, 4 aa, Glycine soja
RSSD

SEQ ID NO: 3553 - protein, 4 aa, Phaseolus angularis
GSTD

SEQ ID NO: 3554 - protein, 4 aa, Phaseolus angularis
RSTD

SEQ ID NO: 3555 - protein, 4 aa, Glycine max
RSRD

SEQ ID NO: 3556 - protein, 4 aa, Medicago truncatula
GGIE

SEQ ID NO: 3557 - protein, 5 aa, Medicago truncatula
GDIVT

SEQ ID NO: 3558 - protein, 5 aa, Medicago truncatula
GDSEE

SEQ ID NO: 3559 - protein, 4 aa, Vicia hirsute
GSSD

SEQ ID NO: 3560 - protein, 4 aa, Trigonella foenum-graecum
RSSD

SEQ ID NO: 3561 - protein, 4 aa, Onobrychis viciifolia
GSTD

SEQ ID NO: 3562 - protein, 5 aa, Mundulea sericea
GDAQN

SEQ ID NO: 3563 - protein, 4 aa, Melilotus alba
RSSS

SEQ ID NO: 3564 - protein, 5 aa, Philenoptera violacea
DDATN

SEQ ID NO: 3565 - protein, 4 aa, Canavalia brasiliensis
GSSD

SEQ ID NO: 3566 - protein, 4 aa, Bituminaria bituminosa
GSTD

SEQ ID NO: 3567 - protein, 4 aa, Bituminaria bituminosa
GSTD

SEQ ID NO: 3568 - protein, 4 aa, Bituminaria bituminosa
GSTD

SEQ ID NO: 3569 - protein, 5 aa, Phaseolus vulgaris
GSTRD

SEQ ID NO: 3570 - protein, 4 aa, Glycine max
RSRD

SEQ ID NO: 3571 - protein, 4 aa, Medicago truncatula
RSSD

SEQ ID NO: 3572 - protein, 2 aa, Mesobuthus martensii
RE

SEQ ID NO: 3573 - protein, 2 aa, Mesobuthus martensii
RE

SEQ ID NO: 3574 - protein, 2 aa, Mesobuthus tamulus
SE

SEQ ID NO: 3575 - protein, 2 aa, Mesobuthus eupeus
RA

SEQ ID NO: 3576 - protein, 2 aa, Buthus sindicus
AD

SEQ ID NO: 3577 - protein, 2 aa, Leiurus quinquestratus hebraeus
AE

SEQ ID NO: 3578 - protein, 2 aa, Mesobuthus eupeus
RD

SEQ ID NO: 3579 - protein, 2 aa, Mesobuthus tamulus
RK

SEQ ID NO: 3580 - protein, 2 aa, Mesobuthus eupeus
RD

SEQ ID NO: 3581 - protein, 2 aa, Mesobuthus eupeus
RD

SEQ ID NO: 3582 - protein, 2 aa, Leiurus quinquestratus hebraeus
YD

SEQ ID NO: 3583 - protein, 2 aa, Buthus sindicus
AT

SEQ ID NO: 3584 - protein, 2 aa, Leiurus quinquestratus quinquestratus
DD

SEQ ID NO: 3585 - protein, 2 aa, Mesobuthus eupeus
AT

SEQ ID NO: 3586 - protein, 2 aa, Mesobuthus eupeus
RD

SEQ ID NO: 3587 - protein, 2 aa, Centruroides noxius
QD

SEQ ID NO: 3588 - protein, 2 aa, Centruroides elegans
TD

SEQ ID NO: 3589 - protein, 2 aa, Centruroides gracilis
TD

SEQ ID NO: 3590 - protein, 2 aa, Centruroides sculpturatus
QD

SEQ ID NO: 3591 - protein, 2 aa, Centruroides limpidus limpidus
QD

SEQ ID NO: 3592 - protein, 2 aa, Centruroides exilicauda
QD

SEQ ID NO: 3593 - protein, 2 aa, Centruroides noxius
EV

SEQ ID NO: 3594 - protein, 2 aa, Centruroides elegans
EI

SEQ ID NO: 3595 - protein, 2 aa, Centruroides sculpturatus
EV

SEQ ID NO: 3596 - protein, 2 aa, Centruroides gracilis
TA

SEQ ID NO: 3597 - protein, 2 aa, Centruroides limpidus limpidus
DE

SEQ ID NO: 3598 - protein, 2 aa, Centruroides noxius
QD

SEQ ID NO: 3599 - protein, 2 aa, Centruroides exilicauda
DE

SEQ ID NO: 3600 - protein, 2 aa, Centruroides exilicauda
DE

SEQ ID NO: 3601 - protein, 2 aa, Centruroides exilicauda
DE

SEQ ID NO: 3602 - protein, 2 aa, Centruroides limpidus limpidus
DK

SEQ ID NO: 3603 - protein, 2 aa, Centruroides limpidus limpidus
DE

SEQ ID NO: 3604 - protein, 2 aa, Centruroides elegans
DE

SEQ ID NO: 3605 - protein, 2 aa, Centruroides sculpturatus
DD

SEQ ID NO: 3606 - protein, 2 aa, Centruroides sculpturatus
DE

SEQ ID NO: 3607 - protein, 2 aa, Centruroides sculpturatus
DE

SEQ ID NO: 3608 - protein, 2 aa, Centruroides sculpturatus
DE

SEQ ID NO: 3609 - protein, 2 aa, Centruroides sculpturatus
DE

SEQ ID NO: 3610 - protein, 2 aa, Centruroides sculpturatus
EV

SEQ ID NO: 3611 - protein, 2 aa, Centruroides gracilis
TD

SEQ ID NO: 3612 - protein, 3 aa, Momordica charantia
MAQ

SEQ ID NO: 3613 - protein, 3 aa, Momordica charantia
LAQ

SEQ ID NO: 3614 - protein, 3 aa, Lagenaria siceraria
LAD

SEQ ID NO: 3615 - protein, 3 aa, Citrullus lanatus
LAD

SEQ ID NO: 3616 - protein, 3 aa, Cucurbita maxima
LAE

SEQ ID NO: 3617 - protein, 3 aa, Luffa cylindrical
LAE

SEQ ID NO: 3618 - protein, 3 aa, Momordica charantia
PGE

SEQ ID NO: 3619 - protein, 3 aa, Momordica cochinchinensis
PGA

SEQ ID NO: 3620 - protein, 3 aa, Momordica repens
LAQ

SEQ ID NO: 3621 - protein, 3 aa, Momordica repens
LRG

SEQ ID NO: 3622 - protein, 3 aa, Trichosanthes kirilowii
LLD

SEQ ID NO: 3623 - protein, 3 aa, Cucumis sativus
LAG

SEQ ID NO: 3624 - protein, 3 aa, Bryonia dioica
LAG

SEQ ID NO: 3625 - protein, 3 aa, Ecballium elaterium
LAE

SEQ ID NO: 3626 - protein, 3 aa, Luffa cylindrical
MAQ

SEQ ID NO: 3627 - protein, 3 aa, Momordocia charantia
PGA

SEQ ID NO: 3628 - protein, 3 aa, Momordocia cochinchinensis
LAK

SEQ ID NO: 3629 - protein, 3 aa, Sechium edule
LLD

SEQ ID NO: 3630 - protein, 3 aa, Cucumis melo
LAE

SEQ ID NO: 3631 - protein, 3 aa, Cucurbita pepo
LAQ

SEQ ID NO: 3632 - protein, 3 aa, Cyclanthera pedata
LAE

SEQ ID NO: 3633 - protein, 3 aa, Luffa cylindrical
PGE

SEQ ID NO: 3634 - protein, 3 aa, Momordica charantia
PGE

SEQ ID NO: 3635 - protein, 3 aa, Momordica cochinchinensis
LAE

SEQ ID NO: 3636 - protein, 3 aa, Cucurbita maxima
LPG

SEQ ID NO: 3637 - protein, 3 aa, Cucumis sativus
LAQ

SEQ ID NO: 3638 - protein, 3 aa, Luffa cylindrical
LAE

SEQ ID NO: 3639 - protein, 3 aa, Cyclanthera pedata
LAQ

SEQ ID NO: 3640 - protein, 3 aa, Luffa cylindrical
MLD

SEQ ID NO: 3641 - protein, 3 aa, Sechium edule
FPT

SEQ ID NO: 3642 - protein, 3 aa, Cyclanthera pedata
LAE

SEQ ID NO: 3643 - protein, 3 aa, Cyclanthera pedata
LAE

SEQ ID NO: 3644 - protein, 3 aa, Momordica charantia
MAK

SEQ ID NO: 3645 - protein, 3 aa, Cucumis melo
LTG

SEQ ID NO: 3646 - protein, 3 aa, Cucumis melo
LLD

SEQ ID NO: 3647 - protein, 3 aa, Cucumis melo
LLD

SEQ ID NO: 3648 - protein, 7 aa, Hybanthus parviflorus
TITALLG

SEQ ID NO: 3649 - protein, 6 aa, Chassalia parvifolia
ISAAIG

SEQ ID NO: 3650 - protein, 7 aa, Viola baoshanensis
TVTALLG

SEQ ID NO: 3651 - protein, 6 aa, Viola baoshanensis
VTIVIG

SEQ ID NO: 3652 - protein, 7 aa, Viola baoshanensis
TVTALLG

SEQ ID NO: 3653 - protein, 7 aa, Viola baoshanensis
TVTALLG

SEQ ID NO: 3654 - protein, 7 aa, Viola baoshanensis
TVTALLG

SEQ ID NO: 3655 - protein, 7 aa, Viola baoshanensis
TVTALAG

SEQ ID NO: 3656 - protein, 7 aa, Viola baoshanensis
TITALAG

SEQ ID NO: 3657 - protein, 7 aa, Viola baoshanensis
TVTALVG

SEQ ID NO: 3658 - protein, 7 aa, Oldenlandia affinis
TITALLG

SEQ ID NO: 3659 - protein, 7 aa, Oldenlandia affinis
TITALLG

SEQ ID NO: 3660 - protein, 6 aa, Melicytus ramiflorus
FTTIIG

SEQ ID NO: 3661 - protein, 7 aa, Viola hederacea
TVTALLG

SEQ ID NO: 3662 - protein, 7 aa, Viola biflora
TVTALIG

SEQ ID NO: 3663 - protein, 4 aa, Viola odorata
YTPR

SEQ ID NO: 3664 - protein, 7 aa, Hybanthus floribundus E
TVTALVG

SEQ ID NO: 3665 - protein, 4 aa, Hybanthus floribundus E
WIPN

SEQ ID NO: 3666 - protein, 6 aa, Hybanthus floribundus E
ISGVIG

SEQ ID NO: 3667 - protein, 4 aa, Hybanthus floribundus E
WIPG

SEQ ID NO: 3668 - protein, 6 aa, Hybanthus floribundus E
FTAVVG

SEQ ID NO: 3669 - protein, 6 aa, Hybanthus floribundus E
FTGVIG

SEQ ID NO: 3670 - protein, 6 aa, Chassalia parvifolia
ISAALG

SEQ ID NO: 3671 - protein, 6 aa, Chassalia parvifolia
ITSVAG

SEQ ID NO: 3672 - protein, 6 aa, Chassalia parvifolia
VTSIFN

SEQ ID NO: 3673 - protein, 6 aa, Chassalia parvifolia
LTSVFN

SEQ ID NO: 3674 - protein, 7 aa, Psychotria longipes
TVTALLG

SEQ ID NO: 3675 - protein, 6 aa, Viola baoshanensis
FTAPLG

SEQ ID NO: 3676 - protein, 6 aa, Viola baoshanensis
LTSAIG

SEQ ID NO: 3677 - protein, 6 aa, Viola baoshanensis
ISSVIG

SEQ ID NO: 3678 - protein, 6 aa, Viola baoshanensis
ISEMIN

SEQ ID NO: 3679 - protein, 6 aa, Viola baoshanensis
ISSAIG

SEQ ID NO: 3680 - protein, 6 aa, Viola baoshanensis
ISGAIG

SEQ ID NO: 3681 - protein, 6 aa, Viola baoshanensis
LTATIG

SEQ ID NO: 3682 - protein, 4 aa, Viola baoshanensis
RTVG

SEQ ID NO: 3683 - protein, 6 aa, Viola baoshanensis
FTAPLG

SEQ ID NO: 3684 - protein, 6 aa, Viola baoshanensis
LTAAIG

SEQ ID NO: 3685 - protein, 6 aa, Viola baoshanensis
LTSAIG

SEQ ID NO: 3686 - protein, 6 aa, Viola baoshanensis
LTSAVG

SEQ ID NO: 3687 - protein, 6 aa, Viola baoshanensis
ISAAIG

SEQ ID NO: 3688 - protein, 6 aa, Viola baoshanensis
ISAAIG

SEQ ID NO: 3689 - protein, 6 aa, Viola baoshanensis
ISSAIG

SEQ ID NO: 3690 - protein, 6 aa, Viola baoshanensis
LTSAIG

SEQ ID NO: 3691 - protein, 7 aa, Viola baoshanensis
ITHVPGT

SEQ ID NO: 3692 - protein, 6 aa, Viola baoshanensis
LTSAIG

SEQ ID NO: 3693 - protein, 6 aa, Viola baoshanensis
ISSAIG

SEQ ID NO: 3694 - protein, 6 aa, Viola baoshanensis
ISSAVG

SEQ ID NO: 3695 - protein, 6 aa, Viola baoshanensis
LTSAVG

SEQ ID NO: 3696 - protein, 6 aa, Viola baoshanensis
ITGVIG

SEQ ID NO: 3697 - protein, 4 aa, Leonia cymosa
FTVG

SEQ ID NO: 3698 - protein, 6 aa, Leonia cymosa
LTTVAG

SEQ ID NO: 3699 - protein, 6 aa, Leonia cymosa
ISAAIG

SEQ ID NO: 3700 - protein, 6 aa, Hedyotis centranthoides
VTSAIG

SEQ ID NO: 3701 - protein, 6 aa, Hedyotis terminalis
VTSTIG

SEQ ID NO: 3702 - protein, 4 aa, Oldenlandia affinis
NDSS

SEQ ID NO: 3703 - protein, 6 aa, Oldenlandia affinis
ISTVLG

SEQ ID NO: 3704 - protein, 6 aa, Oldenlandia affinis
ISGVIG

SEQ ID NO: 3705 - protein, 6 aa, Melicytus ramiflorus
LTSAIG

SEQ ID NO: 3706 - protein, 6 aa, Melicytus ramiflorus
LTSAIG

SEQ ID NO: 3707 - protein, 6 aa, Melicytus ramiflorus
LTSIVG

SEQ ID NO: 3708 - protein, 6 aa, Viola hederacea
FTEVIG

SEQ ID NO: 3709 - protein, 6 aa, Viola biflora
LTSTVG

SEQ ID NO: 3710 - protein, 6 aa, Viola biflora
LTSAVG

SEQ ID NO: 3711 - protein, 6 aa, Viola tricolor
ITSAIG

SEQ ID NO: 3712 - protein, 6 aa, Hybathus floribundus E
FTGIAG

SEQ ID NO: 3713 - protein, 4 aa, Hybathus floribundus E
FLPN

SEQ ID NO: 3714 - protein, 4 aa, Hybathus floribundus E
FNPG

SEQ ID NO: 3715 - protein, 4 aa, Psychotria suterella
HAAG

SEQ ID NO: 3716 - protein, 6 aa, Chassalia parvifolia
ISTLLG

SEQ ID NO: 3717 - protein, 6 aa, Viola baoshanensis
ISSVIG

SEQ ID NO: 3718 - protein, 4 aa, Viola baoshanensis
YTVG

SEQ ID NO: 3719 - protein, 4 aa, Viola baoshanensis
NTPG

SEQ ID NO: 3720 - protein, 4 aa, Viola baoshanensis
NTPG

SEQ ID NO: 3721 - protein, 4 aa, Viola hederacea
FIPG

SEQ ID NO: 3722 - protein, 4 aa, Viola hederacea
NTPG

SEQ ID NO: 3723 - protein, 6 aa, Viola odorata
ISAVVG

SEQ ID NO: 3724 - protein, 4 aa, Viola odorata
NTPG

SEQ ID NO: 3725 - protein, 4 aa, Viola odorata
YTPG

SEQ ID NO: 3726 - protein, 4 aa, Viola odorata
YTPG

SEQ ID NO: 3727 - protein, 6 aa, Viola odorata
ISSVVG

SEQ ID NO: 3728 - protein, 4 aa, Viola odorata
YTPG

SEQ ID NO: 3729 - protein, 4 aa, Viola odorata
NTPG

SEQ ID NO: 3730 - protein, 4 aa, Viola odorata
NTPG

SEQ ID NO: 3731 - protein, 4 aa, Viola odorata
NTPG

SEQ ID NO: 3732 - protein, 6 aa, Viola odorata
ISAAVG

SEQ ID NO: 3733 - protein, 6 aa, Viola odorata
ISSVVG

SEQ ID NO: 3734 - protein, 6 aa, Leonia cymosa
ISAAIG

SEQ ID NO: 3735 - protein, 4 aa, Oldenlandia affinis
NTPG

SEQ ID NO: 3736 - protein, 4 aa, Oldenlandia affinis
NTPG

SEQ ID NO: 3737 - protein, 4 aa, Oldenlandia affinis
NTPG

SEQ ID NO: 3738 - protein, 4 aa, Oldenlandia affinis
NTPG

SEQ ID NO: 3739 - protein, 4 aa, Oldenlandia affinis
NTPG

SEQ ID NO: 3740 - protein, 4 aa, Oldenlandia affinis
NTPG

SEQ ID NO: 3741 - protein, 4 aa, Oldenlandia affinis
YTPG

SEQ ID NO: 3742 - protein, 4 aa, Oldenlandia affinis
NTPG

SEQ ID NO: 3743 - protein, 4 aa, Oldenlandia affinis
NTPG

SEQ ID NO: 3744 - protein, 4 aa, Oldenlandia affinis
NTPG

SEQ ID NO: 3745 - protein, 4 aa, Oldenlandia affinis
NTPG

SEQ ID NO: 3746 - protein, 4 aa, Oldenlandia affinis
YTQG

SEQ ID NO: 3747 - protein, 4 aa, Oldenlandia affinis
NTPG

SEQ ID NO: 3748 - protein, 6 aa, Melicytus ramiflorus
ISSLLG

SEQ ID NO: 3749 - protein, 6 aa, Melicytus ramiflorus
ISSVLG

SEQ ID NO: 3750 - protein, 4 aa, Melicytus ramiflorus
YTPG

SEQ ID NO: 3751 - protein, 4 aa, Melicytus ramiflorus
YTPG

SEQ ID NO: 3752 - protein, 6 aa, Melicytus ramiflorus
ISSIVG

SEQ ID NO: 3753 - protein, 6 aa, Melicytus ramiflorus
ISSVVG

SEQ ID NO: 3754 - protein, 6 aa, Melicytus ramiflorus
LTSAIG

SEQ ID NO: 3755 - protein, 6 aa, Melicytus ramiflorus
ISSLLG

SEQ ID NO: 3756 - protein, 6 aa, Melicytus ramiflorus
ISSIVG

SEQ ID NO: 3757 - protein, 4 aa, Viola odorata
NTPG

SEQ ID NO: 3758 - protein, 4 aa, Viola odorata
NTPG

SEQ ID NO: 3759 - protein, 4 aa, Viola odorata
NTPG

SEQ ID NO: 3760 - protein, 4 aa, Viola odorata
NTPG

SEQ ID NO: 3761 - protein, 4 aa, Viola odorata
NTPG

SEQ ID NO: 3762 - protein, 4 aa, Viola odorata
YTAG

SEQ ID NO: 3763 - protein, 4 aa, Viola odorata
NTPG

SEQ ID NO: 3764 - protein, 4 aa, Viola odorata
NTPG

SEQ ID NO: 3765 - protein, 4 aa, Viola hederacea
YTNG

SEQ ID NO: 3766 - protein, 4 aa, Viola biflora
NTPG

SEQ ID NO: 3767 - protein, 4 aa, Viola biflora
NTPG

SEQ ID NO: 3768 - protein, 4 aa, Viola biflora
YTPG

SEQ ID NO: 3769 - protein, 4 aa, Viola biflora
NTPG

SEQ ID NO: 3770 - protein, 6 aa, Viola biflora
LTSALG

SEQ ID NO: 3771 - protein, 6 aa, Viola biflora
LTSAIG

SEQ ID NO: 3772 - protein, 6 aa, Viola biflora
LTTVIG

SEQ ID NO: 3773 - protein, 6 aa, Viola biflora
ISKVIG

SEQ ID NO: 3774 - protein, 6 aa, Viola cotyledon
FTGIAG

SEQ ID NO: 3775 - protein, 6 aa, Viola cotyledon
ITGIAG

SEQ ID NO: 3776 - protein, 4 aa, Viola arvensis
NTPG

SEQ ID NO: 3777 - protein, 4 aa, Viola odorata
YTVQ

SEQ ID NO: 3778 - protein, 4 aa, Viola odorata
YTAG

SEQ ID NO: 3779 - protein, 6 aa, Chassalia discolor
ISYLVG

SEQ ID NO: 3780 - protein, 6 aa, Hybanthus floribundus E
YTEELG

SEQ ID NO: 3781 - protein, 6 aa, Hybanthus floribundus E
YTEELG

SEQ ID NO: 3782 - protein, 4 aa, Viola odorata
YTPG

SEQ ID NO: 3783 - protein, 4 aa, Oldenlandia affinis
YTTG

SEQ ID NO: 3784 - protein, 4 aa, Oldenlandia affinis
YTPG

SEQ ID NO: 3785 - protein, 4 aa, Oldenlandia affinis
YTPG

SEQ ID NO: 3786 - protein, 4 aa, Melcytus ramiflorus
YTPG

SEQ ID NO: 3787 - protein, 7 aa, Palicourea condensata
TYSAALG

SEQ ID NO: 3788 - protein, 4 aa, Viola yedoensis
YTPG

SEQ ID NO: 3789 - protein, 4 aa, Viola yedoensis
YTAG

SEQ ID NO: 3790 - protein, 4 aa, Viola yedoensis
YTAG

SEQ ID NO: 3791 - protein, 4 aa, Viola arvensis
YTKG

SEQ ID NO: 3792 - protein, 4 aa, Viola arvensis
YTKG

SEQ ID NO: 3793 - protein, 4 aa, Tachypleus tridentatus
RGLT

SEQ ID NO: 3794 - protein, 4 aa, Tachypleus tridentatus
RGLT

SEQ ID NO: 3795 - protein, 4 aa, Tachypleus tridentatus
FGYY

SEQ ID NO: 3796 - protein, 4 aa, Tachypleus tridentatus
FGYY

SEQ ID NO: 3797 - protein, 5 aa, Takifugu rubripes
DFCAF

SEQ ID NO: 3798 - protein, 5 aa, Takifugu rubripes
HPQAL

SEQ ID NO: 3799 - protein, 5 aa, Takifugu rubripes
DPCDT

SEQ ID NO: 3800 - protein, 5 aa, Takifugu rubripes
DPCAS

SEQ ID NO: 3801 - protein, 5 aa, Aotus sp. Aot1
HPCAS

SEQ ID NO: 3802 - protein, 5 aa, Mus musculus
DPCAS

SEQ ID NO: 3803 - protein, 5 aa, Canis lupus
DPCAS

SEQ ID NO: 3804 - protein, 5 aa, Tetrao urogallus
DPCAT

SEQ ID NO: 3805 - protein, 5 aa, Tragopan temminckii
DPCAT

SEQ ID NO: 3806 - protein, 5 aa, Tragopan satyra
DPCAT

SEQ ID NO: 3807 - protein, 5 aa, Syrmaticus reevesii
DPCAT

SEQ ID NO: 3808 - protein, 5 aa, Rollulus roulroul
DPCAT

SEQ ID NO: 3809 - protein, 5 aa, Perdix perdix
DPCAT

SEQ ID NO: 3810 - protein, 5 aa, Polyplectron malacense
DPCAT

SEQ ID NO: 3811 - protein, 5 aa, Pavo muticus
DPCAT

SEQ ID NO: 3812 - protein, 5 aa, Polyplectron inopinatum
DPCAT

SEQ ID NO: 3813 - protein, 5 aa, Polyplectron napolenois
DPCAT

SEQ ID NO: 3814 - protein, 5 aa, Phasianus colchincus
DPCAT

SEQ ID NO: 3815 - protein, 5 aa, Pavo cristatus
DPCAT

SEQ ID NO: 3816 - protein, 5 aa, Melegaris gallopavo
DPCAT

SEQ ID NO: 3817 - protein, 5 aa, Tetrao tetrix
DPCAT

SEQ ID NO: 3818 - protein, 5 aa, Lophura nycthemera
DPCAT

SEQ ID NO: 3819 - protein, 5 aa, Lagopus lagopus scotica
DPCAT

SEQ ID NO: 3820 - protein, 5 aa, Lophophorus impejanus
DPCAT

SEQ ID NO: 3821 - protein, 5 aa, Lophura edwardsi
DPCAT

SEQ ID NO: 3822 - protein, 5 aa, Lophura diardi
DPCAT

SEQ ID NO: 3823 - protein, 5 aa, Gallus sonneratii
DPCAT

SEQ ID NO: 3824 - protein, 5 aa, Francolinus pondicerianus
DPCAT

SEQ ID NO: 3825 - protein, 5 aa, Francolinus levaillantii
DPCAT

SEQ ID NO: 3826 - protein, 5 aa, Catreus wallichii
DPCAT

SEQ ID NO: 3827 - protein, 5 aa, Crossoptilon mantchuricum
DPCAT

SEQ ID NO: 3828 - protein, 5 aa, Coturnix coturnix japonica
DPCAT

SEQ ID NO: 3829 - protein, 5 aa, Coturnix coturnix
DPCAT

SEQ ID NO: 3830 - protein, 5 aa, Crossoptilon crossoptilon
DPCAT

SEQ ID NO: 3831 - protein, 5 aa, Alectoris chukar
DPCAT

SEQ ID NO: 3832 - protein, 5 aa, Afropavo congensis
DPCAT

SEQ ID NO: 3833 - protein, 5 aa, Argusianus argus
DPCAT

SEQ ID NO: 3834 - protein, 5 aa, Alectoris rufa
DPCAT

SEQ ID NO: 3835 - protein, 5 aa, Peromyscus maniculatus
DPCAS

SEQ ID NO: 3836 - protein, 5 aa, Peromyscus polionotus subgriseus
DPCAS

SEQ ID NO: 3837 - protein, 5 aa, Peromyscus polionotus leucocephalus
DPCAS

SEQ ID NO: 3838 - protein, 5 aa, Coturnix coturnix japonica
NYCAL

SEQ ID NO: 3839 - protein, 5 aa, Coturnix coturnix japonica
NYCAL

SEQ ID NO: 3840 - protein, 5 aa, Capra hircus
DPCAF

SEQ ID NO: 3841 - protein, 5 aa, Bos taurus
DPCAT

SEQ ID NO: 3842 - protein, 5 aa, Homo sapiens
DPCAT

SEQ ID NO: 3843 - protein, 5 aa, Mus musculus
DPCAT

SEQ ID NO: 3844 - protein, 5 aa, Sus scrofa
DPCAT

SEQ ID NO: 3845 - protein, 5 aa, Bos taurus
DPCAF

SEQ ID NO: 3846 - protein, 5 aa, Callithrix geoffroyi
HPCAS

SEQ ID NO: 3847 - protein, 5 aa, Callimico goeldii
HPCAS

SEQ ID NO: 3848 - protein, 5 aa, Callithrix jacchus
HPCAS

SEQ ID NO: 3849 - protein, 5 aa, Canis familiaris
DPCAS

SEQ ID NO: 3850 - protein, 5 aa, Cebuella pygmaea
HPCAS

SEQ ID NO: 3851 - protein, 5 aa, Chlorocebus aethiops
DPCAS

SEQ ID NO: 3852 - protein, 5 aa, Cercopithecus mitis
DPCAS

SEQ ID NO: 3853 - protein, 5 aa, Colobus polykomos
DPCAS

SEQ ID NO: 3854 - protein, 5 aa, Erythrocebus patas
DPCAS

SEQ ID NO: 3855 - protein, 5 aa, Felis catus
DPCAS

SEQ ID NO: 3856 - protein, 5 aa, Gorilla gorilla gorilla
DPCAS

SEQ ID NO: 3857 - protein, 5 aa, Equus caballus
DPCAS

SEQ ID NO: 3858 - protein, 5 aa, Homo sapiens
DPCAS

SEQ ID NO: 3859 - protein, 5 aa, Leontopithecus chrysomelas
HPCAS

SEQ ID NO: 3860 - protein, 5 aa, Leontopithecus rosalia
HPCAS

SEQ ID NO: 3861 - protein, 5 aa, Macaca arctoides
DPCAS

SEQ ID NO: 3862 - protein, 5 aa, Macaca assamensis
DPCAS

SEQ ID NO: 3863 - protein, 5 aa, Macaca cyclopis
DPCAS

SEQ ID NO: 3864 - protein, 5 aa, Macaca fascicularis
DPCAS

SEQ ID NO: 3865 - protein, 5 aa, Macaca fuscata fuscata
DPCAS

SEQ ID NO: 3866 - protein, 5 aa, Macaca hecki
DPCAF

SEQ ID NO: 3867 - protein, 5 aa, Macaca maura
DPCAS

SEQ ID NO: 3868 - protein, 5 aa, Macaca mulatta
DPCAS

SEQ ID NO: 3869 - protein, 5 aa, Macaca nemestrina
DPCAS

SEQ ID NO: 3870 - protein, 5 aa, Macaca nigra
DPCAS

SEQ ID NO: 3871 - protein, 5 aa, Macaca nigrescens
DPCAS

SEQ ID NO: 3872 - protein, 5 aa, Macaca radiata
DPCAS

SEQ ID NO: 3873 - protein, 5 aa, Macaca sinica
DPCAS

SEQ ID NO: 3874 - protein, 5 aa, Macaca silenus
DPCAS

SEQ ID NO: 3875 - protein, 5 aa, Macaca sylvanus
DPCAS

SEQ ID NO: 3876 - protein, 5 aa, Mus musculus
DPCAS

SEQ ID NO: 3877 - protein, 5 aa, Pan paniscus
DPCAS

SEQ ID NO: 3878 - protein, 5 aa, Pan troglodytes
DPCAS

SEQ ID NO: 3879 - protein, 5 aa, Papio anubis
DPCAS

SEQ ID NO: 3880 - protein, 5 aa, Sus scrofa
DPCAF

SEQ ID NO: 3881 - protein, 5 aa, Pongo pygmaeus
DPCAS

SEQ ID NO: 3882 - protein, 5 aa, Rattus norvegicus
NPCAS

SEQ ID NO: 3883 - protein, 5 aa, Semnopithecus entellus
DPCAS

SEQ ID NO: 3884 - protein, 5 aa, Trachypithecus auratus
DPCAS

SEQ ID NO: 3885 - protein, 5 aa, Trachypithecus cristatus
DPCAS

SEQ ID NO: 3886 - protein, 5 aa, Trachypithecus francoisi
DPCAS

SEQ ID NO: 3887 - protein, 5 aa, Trachypithecus obscurus
DPCAS

SEQ ID NO: 3888 - protein, 5 aa, Vulpes vulpes
DPCAS

SEQ ID NO: 3889 - protein, 5 aa, Oryctolagus cuniculus
DPCAS

SEQ ID NO: 3890 - protein, 5 aa, Coturnix coturnix japonica
NYCAL

SEQ ID NO: 3891 - protein, 5 aa, Gallus gallus
NYCAL

SEQ ID NO: 3892 - protein, 5 aa, Gallus gallus
NYCAL

SEQ ID NO: 3893 - protein, 5 aa, Gallus gallus
NYCAL

SEQ ID NO: 3894 - protein, 5 aa, Mus musculus
DPCAT

SEQ ID NO: 3895 - protein, 5 aa, Capra hircus
DPCAF

SEQ ID NO: 3896 - protein, 5 aa, Tetraodon nigroviridis
DPCDT

SEQ ID NO: 3897 - protein, 5 aa, Tetraodon nigroviridis
DPCAS

SEQ ID NO: 3898 - protein, 5 aa, Carassius auratus
DQCAF

SEQ ID NO: 3899 - protein, 5 aa, Carassius auratus
DQCAF

SEQ ID NO: 3900 - protein, 5 aa, Carassius auratus
DQCAF

SEQ ID NO: 3901 - protein, 5 aa, Canis familiaris
DPCAS

SEQ ID NO: 3902 - protein, 5 aa, Canis lupus
DPCAS

SEQ ID NO: 3903 - protein, 5 aa, Canis latrans
DPCAS

SEQ ID NO: 3904 - protein, 5 aa, Ovis aries
DPCAT

SEQ ID NO: 3905 - protein, 5 aa, Carassius auratus
NPCDT

SEQ ID NO: 3906 - protein, 5 aa, Carassius auratus
NPCDT

SEQ ID NO: 3907 - protein, 5 aa, Coturnix coturnix japonica
DPCAT

SEQ ID NO: 3908 - protein, 5 aa, Sus scrofa
DPCAT

SEQ ID NO: 3909 - protein, 5 aa, Gallus gallus
DPCAT

SEQ ID NO: 3910 - protein, 5 aa, Rattus norvegicus
DLCAT

SEQ ID NO: 3911 - protein, 5 aa, Gallus gallus
DPCAT

SEQ ID NO: 3912 - protein, 4 aa, Amaranthus hypochondriacus
EPYT

SEQ ID NO: 3913 - protein, 4 aa, Agriosphodrus dohrni
KGTT

SEQ ID NO: 3914 - protein, 4 aa, Isyndus obscurs
EKTT

SEQ ID NO: 3915 - protein, 5 aa, Peirates turpis
NPRAW

SEQ ID NO: 3916 - protein, 3 aa, Conus vexillum
EGV

SEQ ID NO: 3917 - protein, 3 aa, Conus abbreviates
SNF

SEQ ID NO: 3918 - protein, 3 aa, Conus abbreviates
SQS

SEQ ID NO: 3919 - protein, 3 aa, Conus abbreviates
SQS

SEQ ID NO: 3920 - protein, 3 aa, Conus abbreviates
SKA

SEQ ID NO: 3921 - protein, 3 aa, Conus abbreviates
SKI

SEQ ID NO: 3922 - protein, 3 aa, Conus abbreviates
SQV

SEQ ID NO: 3923 - protein, 3 aa, Conus abbreviates
SQY

SEQ ID NO: 3924 - protein, 3 aa, Conus abbreviates
SNA

SEQ ID NO: 3925 - protein, 3 aa, Conus abbreviates
SNA

SEQ ID NO: 3926 - protein, 3 aa, Conus abbreviates
IPF

SEQ ID NO: 3927 - protein, 3 aa, Conus abbreviates
ILF

SEQ ID NO: 3928 - protein, 3 aa, Conus abbreviates
ILF

SEQ ID NO: 3929 - protein, 3 aa, Conus abbreviates
ILF

SEQ ID NO: 3930 - protein, 3 aa, Conus abbreviates
FLT

SEQ ID NO: 3931 - protein, 3 aa, Conus abbreviates
SMS

SEQ ID NO: 3932 - protein, 3 aa, Conus abbreviates
SMS

SEQ ID NO: 3933 - protein, 3 aa, Conus abbreviates
SMS

SEQ ID NO: 3934 - protein, 3 aa, Conus aurisiacus
SEI

SEQ ID NO: 3935 - protein, 3 aa, Conus ammiralis
EGY

SEQ ID NO: 3936 - protein, 3 aa, Conus ammiralis
NNF

SEQ ID NO: 3937 - protein, 3 aa, Conus ammiralis
SGW

SEQ ID NO: 3938 - protein, 3 aa, Conus amadis
VGT

SEQ ID NO: 3939 - protein, 3 aa, Conus arenatus
SGE

SEQ ID NO: 3940 - protein, 4 aa, Conus arenatus
PGLR

SEQ ID NO: 3941 - protein, 4 aa, Conus arenatus
AGLS

SEQ ID NO: 3942 - protein, 4 aa, Conus arenatus
PGLM

SEQ ID NO: 3943 - protein, 3 aa, Conus arenatus
SGE

SEQ ID NO: 3944 - protein, 3 aa, Conus arenatus
SNH

SEQ ID NO: 3945 - protein, 3 aa, Conus arenatus
SNH

SEQ ID NO: 3946 - protein, 3 aa, Conus arenatus
SNH

SEQ ID NO: 3947 - protein, 3 aa, Conus arenatus
SLY

SEQ ID NO: 3948 - protein, 3 aa, Conus arenatus
SLW

SEQ ID NO: 3949 - protein, 3 aa, Conus arenatus
SGR

SEQ ID NO: 3950 - protein, 3 aa, Conus arenatus
SGW

SEQ ID NO: 3951 - protein, 8 aa, Conus arenatus
  misc_feature (3)..(3): Xaa can be any naturally occurring amino acid
GEXDGEPV

SEQ ID NO: 3952 - protein, 8 aa, Conus arenatus
GLEDGEPV

SEQ ID NO: 3953 - protein, 8 aa, Conus arenatus
GEEDGEPV

SEQ ID NO: 3954 - protein, 8 aa, Conus arenatus
GEEDGEPV

SEQ ID NO: 3955 - protein, 8 aa, Conus arenatus
HENNGVYT

SEQ ID NO: 3956 - protein, 7 aa, Conus arenatus
NTNNGPS

SEQ ID NO: 3957 - protein, 7 aa, Conus arenatus
NTNNGPS

SEQ ID NO: 3958 - protein, 8 aa, Conus arenatus
GLENGQPF

SEQ ID NO: 3959 - protein, 3 aa, Conus arenatus
SQL

SEQ ID NO: 3960 - protein, 2 aa, Conus arenatus
HD

SEQ ID NO: 3961 - protein, 2 aa, Conus arenatus
DD

SEQ ID NO: 3962 - protein, 2 aa, Conus arenatus
DD

SEQ ID NO: 3963 - protein, 2 aa, Conus arenatus
HF

SEQ ID NO: 3964 - protein, 2 aa, Conus arenatus
ND

SEQ ID NO: 3965 - protein, 4 aa, Conus arenatus
PGLR

SEQ ID NO: 3966 - protein, 3 aa, Conus austini
SSS

SEQ ID NO: 3967 - protein, 3 aa, Conus Aristophanes
SDV

SEQ ID NO: 3968 - protein, 3 aa, Conus Aristophanes
SRA

SEQ ID NO: 3969 - protein, 3 aa, Conus Aristophanes
YMT

SEQ ID NO: 3970 - protein, 3 aa, Conus Aristophanes
SKY

SEQ ID NO: 3971 - protein, 3 aa, Conus Aristophanes
SQS

SEQ ID NO: 3972 - protein, 3 aa, Conus Aristophanes
GDF

SEQ ID NO: 3973 - protein, 3 aa, Conus Aristophanes
EDF

SEQ ID NO: 3974 - protein, 3 aa, Conus Aristophanes
DLY

SEQ ID NO: 3975 - protein, 3 aa, Conus aulicus
DGT

SEQ ID NO: 3976 - protein, 2 aa, Conus aulicus
GY

SEQ ID NO: 3977 - protein, 3 aa, Conus aulicus
SGW

SEQ ID NO: 3978 - protein, 3 aa, Conus bullatus
SEF

SEQ ID NO: 3979 - protein, 3 aa, Conus betulinus
QLY

SEQ ID NO: 3980 - protein, 3 aa, Conus betulinus
SGE

SEQ ID NO: 3981 - protein, 7 aa, Conus radiates
GPPGDWQ

SEQ ID NO: 3982 - protein, 3 aa, Conus catus
SEL

SEQ ID NO: 3983 - protein, 3 aa, Conus catus
TGS

SEQ ID NO: 3984 - protein, 3 aa, Conus catus
TGS

SEQ ID NO: 3985 - protein, 3 aa, Conus catus
TGS

SEQ ID NO: 3986 - protein, 3 aa, Conus catus
SGS

SEQ ID NO: 3987 - protein, 3 aa, Conus catus
TGS

SEQ ID NO: 3988 - protein, 3 aa, Conus catus
TGS

SEQ ID NO: 3989 - protein, 3 aa, Conus catus
TGS

SEQ ID NO: 3990 - protein, 3 aa, Conus catus
TGS

SEQ ID NO: 3991 - protein, 3 aa, Conus catus
RGS

SEQ ID NO: 3992 - protein, 3 aa, Conus catus
TGS

SEQ ID NO: 3993 - protein, 3 aa, Conus catus
SGS

SEQ ID NO: 3994 - protein, 3 aa, Conus catus
SEL

SEQ ID NO: 3995 - protein, 3 aa, Conus caracteristicus
TGF

SEQ ID NO: 3996 - protein, 7 aa, Conus caracteristicus
NTNNGPS

SEQ ID NO: 3997 - protein, 4 aa, Conus capitaneus
SGLR

SEQ ID NO: 3998 - protein, 3 aa, Conus consors
SEF

SEQ ID NO: 3999 - protein, 3 aa, Conus consors
SNL

SEQ ID NO: 4000 - protein, 3 aa, Conus consors
HGS

SEQ ID NO: 4001 - protein, 3 aa, Conus coronatus
SDF

SEQ ID NO: 4002 - protein, 3 aa, Conus coronatus
SRA

SEQ ID NO: 4003 - protein, 3 aa, Conus coronatus
SKA

SEQ ID NO: 4004 - protein, 3 aa, Conus coronatus
SKI

SEQ ID NO: 4005 - protein, 3 aa, Conus coronatus
VLF

SEQ ID NO: 4006 - protein, 3 aa, Conus coronatus
SKF

SEQ ID NO: 4007 - protein, 3 aa, Conus coronatus
EHS

SEQ ID NO: 4008 - protein, 3 aa, Conus virgo
SGR

SEQ ID NO: 4009 - protein, 4 aa, Conus virgo
PGLR

SEQ ID NO: 4010 - protein, 4 aa, Conus virgo
PGLR

SEQ ID NO: 4011 - protein, 2 aa, Conus virgo
GR

SEQ ID NO: 4012 - protein, 4 aa, Conus virgo
PGLR

SEQ ID NO: 4013 - protein, 3 aa, Conus virgo
SGW

SEQ ID NO: 4014 - protein, 2 aa, Conus virgo
NA

SEQ ID NO: 4015 - protein, 3 aa, Conus virgo
SGW

SEQ ID NO: 4016 - protein, 3 aa, Conus virgo
SGW

SEQ ID NO: 4017 - protein, 4 aa, Conus virgo
PGLR

SEQ ID NO: 4018 - protein, 3 aa, Conus virgo
SEF

SEQ ID NO: 4019 - protein, 3 aa, Conus ventricosus
SGL

SEQ ID NO: 4020 - protein, 4 aa, Conus dalli
RGWY

SEQ ID NO: 4021 - protein, 4 aa, Conus dalli
RGWH

SEQ ID NO: 4022 - protein, 2 aa, Conus dalli
GY

SEQ ID NO: 4023 - protein, 3 aa, Conus dalli
SGV

SEQ ID NO: 4024 - protein, 3 aa, Conus dalli
SGW

SEQ ID NO: 4025 - protein, 4 aa, Conus dalli
DGFI

SEQ ID NO: 4026 - protein, 4 aa, Conus dalli
PWLI

SEQ ID NO: 4027 - protein, 3 aa, Conus delessertii
SGY

SEQ ID NO: 4028 - protein, 3 aa, Conus delessertii
SGF

SEQ ID NO: 4029 - protein, 2 aa, Conus distans
SY

SEQ ID NO: 4030 - protein, 3 aa, Conus distans
SNL

SEQ ID NO: 4031 - protein, 3 aa, Conus distans
SES

SEQ ID NO: 4032 - protein, 3 aa, Conus ermineus
NKT

SEQ ID NO: 4033 - protein, 2 aa, Conus ermineus
GR

SEQ ID NO: 4034 - protein, 3 aa, Conus ermineus
SGA

SEQ ID NO: 4035 - protein, 3 aa, Conus ermineus
SEL

SEQ ID NO: 4036 - protein, 3 aa, Conus ebraeus
NAF

SEQ ID NO: 4037 - protein, 3 aa, Conus ebraeus
DDF

SEQ ID NO: 4038 - protein, 3 aa, Conus ebraeus
NAF

SEQ ID NO: 4039 - protein, 3 aa, Conus ebraeus
DDF

SEQ ID NO: 4040 - protein, 3 aa, Conus ebraeus
SKS

SEQ ID NO: 4041 - protein, 3 aa, Conus ebraeus
NAF

SEQ ID NO: 4042 - protein, 3 aa, Conus ebraeus
NAF

SEQ ID NO: 4043 - protein, 3 aa, Conus ebraeus
NTF

SEQ ID NO: 4044 - protein, 3 aa, Conus ebraeus
NAF

SEQ ID NO: 4045 - protein, 3 aa, Conus ebraeus
NAF

SEQ ID NO: 4046 - protein, 3 aa, Conus ebraeus
DDF

SEQ ID NO: 4047 - protein, 3 aa, Conus ebraeus
DDF

SEQ ID NO: 4048 - protein, 2 aa, Conus episcopatus
SY

SEQ ID NO: 4049 - protein, 3 aa, Conus geographus
SGW

SEQ ID NO: 4050 - protein, 2 aa, Conus geographus
RS

SEQ ID NO: 4051 - protein, 2 aa, Conus geographus
TS

SEQ ID NO: 4052 - protein, 2 aa, Conus geographus
TS

SEQ ID NO: 4053 - protein, 3 aa, Conus generalis
GGI

SEQ ID NO: 4054 - protein, 3 aa, Conus textile
SED

SEQ ID NO: 4055 - protein, 3 aa, Conus textile
SWD

SEQ ID NO: 4056 - protein, 3 aa, Conus textile
SWD

SEQ ID NO: 4057 - protein, 3 aa, Conus textile
SWN

SEQ ID NO: 4058 - protein, 3 aa, Conus gloriamaris
QGT

SEQ ID NO: 4059 - protein, 3 aa, Conus gloriamaris
TGL

SEQ ID NO: 4060 - protein, 3 aa, Conus gloriamaris
DEL

SEQ ID NO: 4061 - protein, 3 aa, Conus gloriamaris
SGW

SEQ ID NO: 4062 - protein, 4 aa, Conus gloriamaris
YGLI

SEQ ID NO: 4063 - protein, 4 aa, Conus gloriamaris
RGWN

SEQ ID NO: 4064 - protein, 5 aa, Conus imperialis
PEYPT

SEQ ID NO: 4065 - protein, 3 aa, Conus judaeus
RHV

SEQ ID NO: 4066 - protein, 3 aa, Conus judaeus
EEF

SEQ ID NO: 4067 - protein, 3 aa, Conus textile
VGV

SEQ ID NO: 4068 - protein, 3 aa, Conus textile
NSY

SEQ ID NO: 4069 - protein, 3 aa, Conus lividus
SNF

SEQ ID NO: 4070 - protein, 3 aa, Conus litteratus
SGN

SEQ ID NO: 4071 - protein, 4 aa, Conus lividus
PGLH

SEQ ID NO: 4072 - protein, 3 aa, Conus lividus
EVE

SEQ ID NO: 4073 - protein, 8 aa, Conus lividus
GKANGEPR

SEQ ID NO: 4074 - protein, 3 aa, Conus lividus
SKL

SEQ ID NO: 4075 - protein, 3 aa, Conus leopardus
TGS

SEQ ID NO: 4076 - protein, 3 aa, Conus litteratus
YDN

SEQ ID NO: 4077 - protein, 4 aa, Conus litteratus
PGLK

SEQ ID NO: 4078 - protein, 3 aa, Conus litteratus
QLY

SEQ ID NO: 4079 - protein, 2 aa, Conus litteratus
GT

SEQ ID NO: 4080 - protein, 3 aa, Conus litteratus
RGS

SEQ ID NO: 4081 - protein, 3 aa, Conus litteratus
RGS

SEQ ID NO: 4082 - protein, 3 aa, Conus litteratus
SGE

SEQ ID NO: 4083 - protein, 3 aa, Conus lividus
YTY

SEQ ID NO: 4084 - protein, 4 aa, Conus lividus
TGFL

SEQ ID NO: 4085 - protein, 4 aa, Conus lividus
TGFL

SEQ ID NO: 4086 - protein, 4 aa, Conus lividus
TGFL

SEQ ID NO: 4087 - protein, 4 aa, Conus lividus
TGFL

SEQ ID NO: 4088 - protein, 4 aa, Conus lividus
TGFL

SEQ ID NO: 4089 - protein, 3 aa, Conus lividus
SNF

SEQ ID NO: 4090 - protein, 3 aa, Conus lividus
SNF

SEQ ID NO: 4091 - protein, 3 aa, Conus miliaris
SNA

SEQ ID NO: 4092 - protein, 3 aa, Conus miliaris
SKA

SEQ ID NO: 4093 - protein, 3 aa, Conus miliaris
SKS

SEQ ID NO: 4094 - protein, 3 aa, Conus miliaris
SMS

SEQ ID NO: 4095 - protein, 3 aa, Conus miliaris
SNF

SEQ ID NO: 4096 - protein, 3 aa, Conus miliaris
SKI

SEQ ID NO: 4097 - protein, 3 aa, Conus miliaris
ILF

SEQ ID NO: 4098 - protein, 3 aa, Conus magus
TGI

SEQ ID NO: 4099 - protein, 3 aa, Conus magus
SAI

SEQ ID NO: 4100 - protein, 3 aa, Conus magus
SEF

SEQ ID NO: 4101 - protein, 3 aa, Conus magus
SEF

SEQ ID NO: 4102 - protein, 3 aa, Conus magus
SAI

SEQ ID NO: 4103 - protein, 3 aa, Conus magus
SAI

SEQ ID NO: 4104 - protein, 3 aa, Conus magus
TGS

SEQ ID NO: 4105 - protein, 3 aa, Conus magus
TGS

SEQ ID NO: 4106 - protein, 3 aa, Conus magus
SGS

SEQ ID NO: 4107 - protein, 3 aa, Conus magus
SGS

SEQ ID NO: 4108 - protein, 3 aa, Conus marmoreus
SLD

SEQ ID NO: 4109 - protein, 3 aa, Conus marmoreus
SGW

SEQ ID NO: 4110 - protein, 3 aa, Conus marmoreus
SGW

SEQ ID NO: 4111 - protein, 3 aa, Conus marmoreus
SGW

SEQ ID NO: 4112 - protein, 3 aa, Conus marmoreus
SGI

SEQ ID NO: 4113 - protein, 3 aa, Conus marmoreus
SGA

SEQ ID NO: 4114 - protein, 3 aa, Conus magus
SGT

SEQ ID NO: 4115 - protein, 4 aa, Conus magus
FPYS

SEQ ID NO: 4116 - protein, 3 aa, Conus magus
SGT

SEQ ID NO: 4117 - protein, 3 aa, Conus magus
SRQ

SEQ ID NO: 4118 - protein, 4 aa, Conus miles
SDLR

SEQ ID NO: 4119 - protein, 3 aa, Conus miles
GGT

SEQ ID NO: 4120 - protein, 4 aa, Conus miles
PGLE

SEQ ID NO: 4121 - protein, 3 aa, Conus miles
RRY

SEQ ID NO: 4122 - protein, 2 aa, Conus miles
DA

SEQ ID NO: 4123 - protein, 3 aa, Conus miliaris
SNV

SEQ ID NO: 4124 - protein, 3 aa, Conus miliaris
SRA

SEQ ID NO: 4125 - protein, 3 aa, Conus miliaris
SMT

SEQ ID NO: 4126 - protein, 2 aa, Conus miliaris
SE

SEQ ID NO: 4127 - protein, 3 aa, Conus miliaris
SGW

SEQ ID NO: 4128 - protein, 3 aa, Conus miliaris
YTY

SEQ ID NO: 4129 - protein, 3 aa, Conus miliaris
YTY

SEQ ID NO: 4130 - protein, 4 aa, Conus marmoreus
PGLI

SEQ ID NO: 4131 - protein, 4 aa, Conus marmoreus
PGLI

SEQ ID NO: 4132 - protein, 3 aa, Conus nigropunctatus
SVR

SEQ ID NO: 4133 - protein, 4 aa, Conus omaria
SGYN

SEQ ID NO: 4134 - protein, 3 aa, Conus omaria
EGV

SEQ ID NO: 4135 - protein, 3 aa, Conus omaria
FGL

SEQ ID NO: 4136 - protein, 2 aa, Conus omaria
GY

SEQ ID NO: 4137 - protein, 3 aa, Conus omaria
SGW

SEQ ID NO: 4138 - protein, 4 aa, Conus omaria
GGLI

SEQ ID NO: 4139 - protein, 3 aa, Conus purpurascens
GRA

SEQ ID NO: 4140 - protein, 3 aa, Conus purpurascens
GRA

SEQ ID NO: 4141 - protein, 3 aa, Conus purpurascens
GRA

SEQ ID NO: 4142 - protein, 3 aa, Conus purpurascens
SEL

SEQ ID NO: 4143 - protein, 3 aa, Conus purpurascens
SEF

SEQ ID NO: 4144 - protein, 3 aa, Conus purpurascens
SRK

SEQ ID NO: 4145 - protein, 3 aa, Conus pennaceus
FGL

SEQ ID NO: 4146 - protein, 8 aa, Conus pennaceus
HENNGVYT

SEQ ID NO: 4147 - protein, 8 aa, Conus pennaceus
GLEDGEPV

SEQ ID NO: 4148 - protein, 3 aa, Conus pennaceus
SHV

SEQ ID NO: 4149 - protein, 3 aa, Conus pennaceus
DGK

SEQ ID NO: 4150 - protein, 4 aa, Conus pennaceus
GGLI

SEQ ID NO: 4151 - protein, 2 aa, Conus pennaceus
SY

SEQ ID NO: 4152 - protein, 3 aa, Conus pennaceus
KGL

SEQ ID NO: 4153 - protein, 3 aa, Conus pennaceus
DGK

SEQ ID NO: 4154 - protein, 3 aa, Conus pennaceus
SHV

SEQ ID NO: 4155 - protein, 3 aa, Conus pennaceus
SGN

SEQ ID NO: 4156 - protein, 3 aa, Conus pennaceus
RWS

SEQ ID NO: 4157 - protein, 3 aa, Conus pennaceus
TEV

SEQ ID NO: 4158 - protein, 3 aa, Conus pennaceus
SGN

SEQ ID NO: 4159 - protein, 3 aa, Conus pennaceus
SGW

SEQ ID NO: 4160 - protein, 3 aa, Conus pennaceus
SNS

SEQ ID NO: 4161 - protein, 3 aa, Conus pulicarius
SGF

SEQ ID NO: 4162 - protein, 3 aa, Conus pulicarius
SQL

SEQ ID NO: 4163 - protein, 3 aa, Conus pulicarius
SLY

SEQ ID NO: 4164 - protein, 3 aa, Conus quercinus
KGY

SEQ ID NO: 4165 - protein, 3 aa, Conus quercinus
SGW

SEQ ID NO: 4166 - protein, 4 aa, Conus quercinus
LPNY

SEQ ID NO: 4167 - protein, 2 aa, Conus radiates
SS

SEQ ID NO: 4168 - protein, 3 aa, Conus radiates
SAS

SEQ ID NO: 4169 - protein, 3 aa, Conus striatus
TGS

SEQ ID NO: 4170 - protein, 3 aa, Conus striatus
STF

SEQ ID NO: 4171 - protein, 3 aa, Conus striatus
FGK

SEQ ID NO: 4172 - protein, 2 aa, Conus striatus
GR

SEQ ID NO: 4173 - protein, 3 aa, Conus striatus
SGS

SEQ ID NO: 4174 - protein, 2 aa, Conus striatus
GY

SEQ ID NO: 4175 - protein, 3 aa, Conus striatus
SEI

SEQ ID NO: 4176 - protein, 3 aa, Conus striatus
TGS

SEQ ID NO: 4177 - protein, 2 aa, Conus striatus
GF

SEQ ID NO: 4178 - protein, 2 aa, Conus striatus
GY

SEQ ID NO: 4179 - protein, 2 aa, Conus striatus
GR

SEQ ID NO: 4180 - protein, 2 aa, Conus striatus
GR

SEQ ID NO: 4181 - protein, 3 aa, Conus striatus
SGS

SEQ ID NO: 4182 - protein, 3 aa, Conus striatus
SEF

SEQ ID NO: 4183 - protein, 3 aa, Conus stercusmuscarum
SEF

SEQ ID NO: 4184 - protein, 3 aa, Conus spurius
SGE

SEQ ID NO: 4185 - protein, 3 aa, Conus striolatus
SEL

SEQ ID NO: 4186 - protein, 3 aa, Conus striolatus
SNL

SEQ ID NO: 4187 - protein, 2 aa, Conus striolatus
GY

SEQ ID NO: 4188 - protein, 2 aa, Conus tulipa
RS

SEQ ID NO: 4189 - protein, 4 aa, Conus tulipa
MGLM

SEQ ID NO: 4190 - protein, 3 aa, Conus textile
SNS

SEQ ID NO: 4191 - protein, 4 aa, Conus textile
PPAY

SEQ ID NO: 4192 - protein, 4 aa, Conus tessulatus
PGTT

SEQ ID NO: 4193 - protein, 3 aa, Conus tessulatus
SGE

SEQ ID NO: 4194 - protein, 3 aa, Conus tessulatus
PGN

SEQ ID NO: 4195 - protein, 8 aa, Conus tessulatus
GRTNGHPR

SEQ ID NO: 4196 - protein, 8 aa, Conus tessulatus
GRTNGHPR

SEQ ID NO: 4197 - protein, 8 aa, Conus tessulatus
GRTNGHPR

SEQ ID NO: 4198 - protein, 8 aa, Conus tessulatus
GLSNGEPV

SEQ ID NO: 4199 - protein, 4 aa, Conus textile
RGWY

SEQ ID NO: 4200 - protein, 3 aa, Conus textile
NGY

SEQ ID NO: 4201 - protein, 3 aa, Conus textile
SGW

SEQ ID NO: 4202 - protein, 3 aa, Conus textile
SGW

SEQ ID NO: 4203 - protein, 3 aa, Conus textile
DGY

SEQ ID NO: 4204 - protein, 3 aa, Conus textile
DGY

SEQ ID NO: 4205 - protein, 3 aa, Conus textile
SGN

SEQ ID NO: 4206 - protein, 3 aa, Conus textile
TGV

SEQ ID NO: 4207 - protein, 3 aa, Conus textile
SNS

SEQ ID NO: 4208 - protein, 3 aa, Conus textile
SNS

SEQ ID NO: 4209 - protein, 4 aa, Conus textile
DWWT

SEQ ID NO: 4210 - protein, 3 aa, Conus textile
DGY

SEQ ID NO: 4211 - protein, 2 aa, Conus textile
GY

SEQ ID NO: 4212 - protein, 3 aa, Conus textile
VGV

SEQ ID NO: 4213 - protein, 3 aa, Conus textile
SGW

SEQ ID NO: 4214 - protein, 4 aa, Conus textile
FGLF

SEQ ID NO: 4215 - protein, 2 aa, Conus textile
GY

SEQ ID NO: 4216 - protein, 3 aa, Conus textile
SGW

SEQ ID NO: 4217 - protein, 3 aa, Conus textile
SGW

SEQ ID NO: 4218 - protein, 3 aa, Conus textile
SGW

SEQ ID NO: 4219 - protein, 3 aa, Conus textile
DAT

SEQ ID NO: 4220 - protein, 4 aa, Conus textile
DGLF

SEQ ID NO: 4221 - protein, 3 aa, Conus textile
TGI

SEQ ID NO: 4222 - protein, 3 aa, Conus textile
SDN

SEQ ID NO: 4223 - protein, 2 aa, Conus victoriae
GY

SEQ ID NO: 4224 - protein, 3 aa, Conus victoriae
SGW

SEQ ID NO: 4225 - protein, 3 aa, Conus victoriae
SGW

SEQ ID NO: 4226 - protein, 2 aa, Conus victoriae
NY

SEQ ID NO: 4227 - protein, 4 aa, Conus victoriae
LGWN

SEQ ID NO: 4228 - protein, 3 aa, Conus victoriae
NSI

SEQ ID NO: 4229 - protein, 3 aa, Conus vexillum
SNH

SEQ ID NO: 4230 - protein, 4 aa, Conus virgo
DGLR

SEQ ID NO: 4231 - protein, 3 aa, Conus virgo
GGI

SEQ ID NO: 4232 - protein, 3 aa, Conus ventricosus
SGE

SEQ ID NO: 4233 - protein, 3 aa, Conus ventricosus
SGW

SEQ ID NO: 4234 - protein, 3 aa, Conus ventricosus
SGW

SEQ ID NO: 4235 - protein, 3 aa, Conus ventricosus
SYL

SEQ ID NO: 4236 - protein, 3 aa, Conus ventricosus
GGT

SEQ ID NO: 4237 - protein, 3 aa, Conus ventricosus
SFS

SEQ ID NO: 4238 - protein, 3 aa, Conus ventricosus
SFS

SEQ ID NO: 4239 - protein, 4 aa, Conus ventricosus
AGLT

SEQ ID NO: 4240 - protein, 4 aa, Conus ventricosus
DGLT

SEQ ID NO: 4241 - protein, 4 aa, Conus ventricosus
EGLV

SEQ ID NO: 4242 - protein, 8 aa, Conus ventricosus
GLENGEPF

SEQ ID NO: 4243 - protein, 3 aa, Conus ventricosus
SGE

SEQ ID NO: 4244 - protein, 8 aa, Conus ventricosus
GLENGQPD

SEQ ID NO: 4245 - protein, 8 aa, Conus ventricosus
GISNGRPI

SEQ ID NO: 4246 - protein, 8 aa, Conus ventricosus
GLTNGRPR

SEQ ID NO: 4247 - protein, 3 aa, Conus ventricosus
SNN

SEQ ID NO: 4248 - protein, 3 aa, Conus ventricosus
TAV

SEQ ID NO: 4249 - protein, 3 aa, Conus ventricosus
SEV

SEQ ID NO: 4250 - protein, 4 aa, Conus ventricosus
SWYT

SEQ ID NO: 4251 - protein, 4 aa, Conus ventricosus
SWYT

SEQ ID NO: 4252 - protein, 3 aa, Conus ventricosus
SGW

SEQ ID NO: 4253 - protein, 3 aa, Conus ventricosus
SGW

SEQ ID NO: 4254 - protein, 3 aa, Conus vexillum
SGT

SEQ ID NO: 4255 - protein, 3 aa, Conus vexillum
SGE

SEQ ID NO: 4256 - protein, 4 aa, Conus geographus
MGLR

SEQ ID NO: 4257 - protein, 3 aa, Conus arenatus
GGM

SEQ ID NO: 4258 - protein, 3 aa, Conus aulicus
GSF

SEQ ID NO: 4259 - protein, 3 aa, Conus betulinus
LNE

SEQ ID NO: 4260 - protein, 3 aa, Conus betulinus
GYL

SEQ ID NO: 4261 - protein, 3 aa, Conus betulinus
GYL

SEQ ID NO: 4262 - protein, 3 aa, Conus capitaneus
RGR

SEQ ID NO: 4263 - protein, 3 aa, Conus emaciatus
WGI

SEQ ID NO: 4264 - protein, 3 aa, Conus episcopatus
GDM

SEQ ID NO: 4265 - protein, 3 aa, Conus episcopatus
HKS

SEQ ID NO: 4266 - protein, 3 aa, Conus figulinus
GME

SEQ ID NO: 4267 - protein, 1 aa, Conus figulinus
N

SEQ ID NO: 4268 - protein, 1 aa, Conus figulinus
N

SEQ ID NO: 4269 - protein, 1 aa, Conus figulinus
N

SEQ ID NO: 4270 - protein, 3 aa, Conus imperialis
RYS

SEQ ID NO: 4271 - protein, 3 aa, Conus imperialis
HKS

SEQ ID NO: 4272 - protein, 3 aa, Conus imperialis
KNV

SEQ ID NO: 4273 - protein, 3 aa, Conus lynceus
GER

SEQ ID NO: 4274 - protein, 1 aa, Conus magus
N

SEQ ID NO: 4275 - protein, 3 aa, Conus magus
WHL

SEQ ID NO: 4276 - protein, 1 aa, Conus magus
N

SEQ ID NO: 4277 - protein, 3 aa, Conus miles
SGR

SEQ ID NO: 4278 - protein, 1 aa, Conus radiates
N

SEQ ID NO: 4279 - protein, 1 aa, Conus radiates
N

SEQ ID NO: 4280 - protein, 1 aa, Conus radiates
N

SEQ ID NO: 4281 - protein, 1 aa, Conus radiates
N

SEQ ID NO: 4282 - protein, 1 aa, Conus radiates
N

SEQ ID NO: 4283 - protein, 1 aa, Conus radiates
N

SEQ ID NO: 4284 - protein, 1 aa, Conus radiates
N

SEQ ID NO: 4285 - protein, 1 aa, Conus radiates
N

SEQ ID NO: 4286 - protein, 1 aa, Conus radiates
N

SEQ ID NO: 4287 - protein, 1 aa, Conus radiates
N

SEQ ID NO: 4288 - protein, 3 aa, Conus radiates
PSV

SEQ ID NO: 4289 - protein, 1 aa, Conus radiates
N

SEQ ID NO: 4290 - protein, 1 aa, Conus radiates
N

SEQ ID NO: 4291 - protein, 1 aa, Conus radiates
N

SEQ ID NO: 4292 - protein, 1 aa, Conus radiates
N

SEQ ID NO: 4293 - protein, 1 aa, Conus radiates
N

SEQ ID NO: 4294 - protein, 1 aa, Conus radiates
N

SEQ ID NO: 4295 - protein, 3 aa, Conus radiates
RFR

SEQ ID NO: 4296 - protein, 5 aa, Conus regius
DPNAV

SEQ ID NO: 4297 - protein, 1 aa, Conus striatus
N

SEQ ID NO: 4298 - protein, 3 aa, Conus striatus
RGT

SEQ ID NO: 4299 - protein, 3 aa, Conus spurius
WRS

SEQ ID NO: 4300 - protein, 3 aa, Conus striolatus
LNE

SEQ ID NO: 4301 - protein, 3 aa, Conus textile
HKS

SEQ ID NO: 4302 - protein, 3 aa, Conus virgo
WGI

SEQ ID NO: 4303 - protein, 3 aa, Conus vexillum
WGI

SEQ ID NO: 4304 - protein, 3 aa, Conus vexillum
WGI

SEQ ID NO: 4305 - protein, 2 aa, Cladosporium fulvum
GR

SEQ ID NO: 4306 - protein, 2 aa, Aspergillus clavatus
PK

SEQ ID NO: 4307 - protein, 2 aa, Aspergillus terreus
NK

SEQ ID NO: 4308 - protein, 2 aa, Neosartorya fischeri
PK

SEQ ID NO: 4309 - protein, 4 aa, Botryotinia fuckeliana
DGFK

SEQ ID NO: 4310 - protein, 4 aa, Botryotinia fuckeliana
HGLM

SEQ ID NO: 4311 - protein, 4 aa, Sclerotinia sclerotiorium
DGFK

SEQ ID NO: 4312 - protein, 4 aa, Laccaria bicolor
RGLI

SEQ ID NO: 4313 - protein, 3 aa, Laccaria bicolor
KKV

SEQ ID NO: 4314 - protein, 3 aa, Laccaria bicolor
SGL

SEQ ID NO: 4315 - protein, 3 aa, Laccaria bicolor
SEL

SEQ ID NO: 4316 - protein, 3 aa, Laccaria bicolor
GRI

SEQ ID NO: 4317 - protein, 3 aa, Laccaria bicolor
SGY

SEQ ID NO: 4318 - protein, 3 aa, Laccaria bicolor
SGH

SEQ ID NO: 4319 - protein, 4 aa, Chaetomium globosum
AGLK

SEQ ID NO: 4320 - protein, 4 aa, Neurospora crassa
SGMK

SEQ ID NO: 4321 - protein, 31 aa, Astyanax mexicanus
VPTDLSPVSLLYLDEYERVILKNYQDMVVEG

SEQ ID NO: 4322 - protein, 31 aa, Astyanax mexicanus
VPTELSPISLLYLDEYEKVVLKNYQDMVVEG

SEQ ID NO: 4323 - protein, 31 aa, Astyanax mexicanus
VPTELSAISMLYLDETDRVVLKNYQEMVVEG

SEQ ID NO: 4324 - protein, 31 aa, Astyanax mexicanus
VPTELSPISLLYLDEFEKVTLKNYQDMVVDG

SEQ ID NO: 4325 - protein, 31 aa, Astyanax mexicanus
VPTELSAISMLYLDEYDKVVLKNYQEMVVEG

SEQ ID NO: 4326 - protein, 31 aa, Paracentrotus lividus
VPTELSAISMLYLDEYEKVVLKNYQDMVVEG

SEQ ID NO: 4327 - protein, 31 aa, Paracentrotus lividus
APTKLSGISMLYFDNNENVVLRQYEDMVVEA

SEQ ID NO: 4328 - protein, 31 aa, Sparus aurata
VPTDLSPISLLYLDEYEKVILKNYQDMVVEG

SEQ ID NO: 4329 - protein, 33 aa, Sparus aurata
VSTESYNITMQIMKIKPHISQHIMDMSFQQHSH

SEQ ID NO: 4330 - protein, 33 aa, Homo sapiens
VPTEESNITMQIMRIKPHQGQHIGEMSFLQHNK

SEQ ID NO: 4331 - protein, 31 aa, Homo sapiens
VPTKLTPISILYIDAGNNVVYKQYEDMVVES

SEQ ID NO: 4332 - protein, 31 aa, Homo sapiens
VPTRLSPISILFIDSANNVVYKQYEDMVVES

SEQ ID NO: 4333 - protein, 31 aa, Homo sapiens
APTQLNAISVLYFDDSSNVILKKYRNMVVRA

SEQ ID NO: 4334 - protein, 31 aa, Paralabidochromis chilotes
VPTELSAISMLYLDEHDKVVLKNYQEMVVEG

SEQ ID NO: 4335 - protein, 33 aa, Danio rerio
TPTVTYNITLEIKRLKPLRHQGDIFMSFAEHSE

SEQ ID NO: 4336 - protein, 31 aa, Sus scrofa; identical to SEQ ID NO: 4333

SEQ ID NO: 4337 - protein, 31 aa, Sus scrofa; identical to SEQ ID NO: 4333

SEQ ID NO: 4338 - protein, 31 aa, Anas platyrhynchos; identical to SEQ ID NO: 4325

SEQ ID NO: 4339 - protein, 31 aa, Anas platyrhynchos; identical to SEQ ID NO: 4325

SEQ ID NO: 4340 - protein, 33 aa, Oryzias latipes
TPTETYNITMEIKRIKPQRQQNDIFMSFTEHSA

SEQ ID NO: 4341 - protein, 31 aa, Bos Taurus
VPTELSAISMLYLDENEKVVLKNYQDMVVEG

SEQ ID NO: 4342 - protein, 31 aa, Capra hircus; identical to SEQ ID NO: 4325

SEQ ID NO: 4343 - protein, 31 aa, Bos Taurus; identical to SEQ ID NO: 4341

SEQ ID NO: 4344 - protein, 31 aa, Oryctolagus cuniculus; identical to SEQ ID NO: 4333

SEQ ID NO: 4345 - protein, 31 aa, Sus scrofa; identical to SEQ ID NO: 4325

SEQ ID NO: 4346 - protein, 31 aa, Nematostella vectensis
APTELSPISVLYFDQDNNVVLKKYNKMVVKA

SEQ ID NO: 4347 - protein, 31 aa, Nematostella vectensis
IPTTLNPISILSLNEFDKVVLKNYKDMVIEG

SEQ ID NO: 4348 - protein, 32 aa, Nematostella vectensis
TPNELSPISILYTEDGSNNVVYKNYKDMVVER

SEQ ID NO: 4349 - protein, 31 aa, Danio rerio
VPSKLSPISILYIDAGNNVVYKQYEDMVVES

SEQ ID NO: 4350 - protein, 31 aa, Homo sapiens; identical to SEQ ID NO: 4333

SEQ ID NO: 4351 - protein, 31 aa, Homo sapiens
APTKLNAISVLYFDDSSNVILKKYRNMVVRS

SEQ ID NO: 4352 - protein, 31 aa, Sus scrofa; identical to SEQ ID NO: 4333

SEQ ID NO: 4353 - protein, 31 aa, Ovis aries
VPTELSAISMLYLDEYDKVALKNYQEMVVEG

SEQ ID NO: 4354 - protein, 31 aa, Xenopus tropicalis
VPTDLSAISMLYLDEYDKVVLKNYQEMVVEG

SEQ ID NO: 4355 - protein, 33 aa, Xenopus tropicalis
VPTESYNITMQIMKIKPHISQHIMDMSFQQHSQ

SEQ ID NO: 4356 - protein, 31 aa, Papio anubis; identical to SEQ ID NO: 4325

SEQ ID NO: 4357 - protein, 31 aa, Papio anubis; identical to SEQ ID NO: 4332

SEQ ID NO: 4358 - protein, 33 aa, Ovis aries
VPTEEFNITMQIMRIKPHQNQHIGEMSFLQHNK

SEQ ID NO: 4359 - protein, 31 aa, Callithrix jacchus; identical to SEQ ID NO: 4332

SEQ ID NO: 4360 - protein, 34 aa, Sistrurus catenatus edwardsii
TATGKRSVGREIMRVDPRKETSKIQVMQFTEHTK

SEQ ID NO: 4361 - protein, 34 aa, Sistrurus catenatus edwardsii
TATGKRSVGREIMRVDPRKETSKIEVMQFTEHTE

SEQ ID NO: 4362 - protein, 31 aa, Culex quinquefasciatus
VPTQLSSISMLYLNEQNKVVLKNYQDMTVVG

SEQ ID NO: 4363 - protein, 31 aa, Homo sapiens; identical to SEQ ID NO: 4333

SEQ ID NO: 4364 - protein, 31 aa, Callicebus moloch; identical to SEQ ID NO: 4332

SEQ ID NO: 4365 - protein, 31 aa, Ambystoma mexicanum; identical to SEQ ID NO: 4341

SEQ ID NO: 4366 - protein, 33 aa, Ochotona curzoniae
VPTEEFNITMQIMRIKPHQGQHIGEMSFLQHNK

SEQ ID NO: 4367 - protein, 33 aa, Ochotona curzoniae; identical to SEQ ID NO: 4366

SEQ ID NO: 4368 - protein, 31 aa, Rhinolophus ferrumequinum; identical to SEQ ID NO: 4325

SEQ ID NO: 4369 - protein, 31 aa, Rhinolophus ferrumequinum; identical to SEQ ID NO: 4332

SEQ ID NO: 4370 - protein, 31 aa, Ovis aries
APTKLNAISVLYFDDNSNVILKKYRNMVVRA

SEQ ID NO: 4371 - protein, 31 aa, Capra hircus; identical to SEQ ID NO: 4370

SEQ ID NO: 4372 - protein, 31 aa, Mus musculus; identical to SEQ ID NO: 4370

SEQ ID NO: 4373 - protein, 31 aa, Homo sapiens; identical to SEQ ID NO: 4333

SEQ ID NO: 4374 - protein, 31 aa, Danio rerio; identical to SEQ ID NO: 4321

SEQ ID NO: 4375 - protein, 31 aa, Danio rerio; identical to SEQ ID NO: 4349

SEQ ID NO: 4376 - protein, 31 aa, Strongylocentrotus purpuratus; identical to SEQ ID NO: 4326

SEQ ID NO: 4377 - protein, 31 aa, Drosophila erecta
VPTQLDSVAMLYLNDQSTVVLKNYQEMTVVG

SEQ ID NO: 4378 - protein, 31 aa, Sorex araneus; identical to SEQ ID NO: 4325

SEQ ID NO: 4379 - protein, 31 aa, Sorex araneus; identical to SEQ ID NO: 4332

SEQ ID NO: 4380 - protein, 31 aa, Saccostrea kegaki
VPTELSSLSLLYTDEHGTVVLKVYQDMVVEG

SEQ ID NO: 4381 - protein, 31 aa, Homo sapiens; identical to SEQ ID NO: 4370

SEQ ID NO: 4382 - protein, 31 aa, Drosophilia grimshawi
VPTQLEGISMLYLNDQRTVVLKNYPDMTVVG

SEQ ID NO: 4383 - protein, 31 aa, Drosophilia mojavensis
VPTQLEGISMLYLNDQRTVVLKNYQDMTVVG

SEQ ID NO: 4384 - protein, 31 aa, Drosophilia virilis; identical to SEQ ID NO: 4383

SEQ ID NO: 4385 - protein, 31 aa, Drosophilia willistoni
VPTQLEGISMLYLNDQSTVVLKNYQDMTVVG

SEQ ID NO: 4386 - protein, 31 aa, Drosophilia yakuba; identical to SEQ ID NO: 4377

SEQ ID NO: 4387 - protein, 31 aa, Drosophilia simulans; identical to SEQ ID NO: 4377

SEQ ID NO: 4388 - protein, 33 aa, Sus scrofa; identical to SEQ ID NO: 4366

SEQ ID NO: 4389 - protein, 31 aa, Xenopus tropicalis
VPTRLSPISILYTDSANNVVYKQYEDMVVES

SEQ ID NO: 4390 - protein, 33 aa, Homo sapiens; identical to SEQ ID NO: 4330

SEQ ID NO: 4391 - protein, 33 aa, Rattus norvegicus
VPTSESNVTMQIMRIKPHQSQHIGEMSFLQHSR

SEQ ID NO: 4392 - protein, 31 aa, Otolemur garnettii; identical to SEQ ID NO: 4325

SEQ ID NO: 4393 - protein, 31 aa, Otolemur garnettii; identical to SEQ ID NO: 4332

SEQ ID NO: 4394 - protein, 31 aa, Salmo salar; identical to SEQ ID NO: 4334

SEQ ID NO: 4395 - protein, 33 aa, Sus scrofa
VPVETVNVTMQLLKIRSGDRPSYVELTFSQHVR

SEQ ID NO: 4396 - protein, 31 aa, Branchiostoma floridae
APTKWSSISMLYFDNNGDVVLRQYEDMVVDG

SEQ ID NO: 4397 - protein, 31 aa, Branchiostoma floridae; identical to SEQ ID NO: 4396

SEQ ID NO: 4398 - protein, 31 aa, Branchiostoma floridae
VPTKLSPISILYIDGKDTVVYKKYDDMVADQ

SEQ ID NO: 4399 - protein, 31 aa, Branchiostoma floridae
VPTDLSPISMLYLNENDQVVLKNYQDMVVEG

SEQ ID NO: 4400 - protein, 31 aa, Branchiostoma floridae
APTALSAISMLYFDESGNVVLRQYEDMVVEG

SEQ ID NO: 4401 - protein, 31 aa, Branchiostoma floridae; identical to SEQ ID NO: 4398

SEQ ID NO: 4402 - protein, 31 aa, Stylophora pistillata
VPTTLDAISMLFMNEHSKVVLKNYQDMVVDG

SEQ ID NO: 4403 - protein, 31 aa, Acropora sp. DZ-2008; identical to SEQ ID NO: 4402

SEQ ID NO: 4404 - protein, 36 aa, Pseudocowpox virus
VPTEEANITMEVMSVSVSSTGSNPGMQNMQFVEHLR

SEQ ID NO: 4405 - protein, 36 aa, Pseudocowpox virus
VPTEEANITMEVMSVSVSSTDSNPGMQNMQFVEHLH

SEQ ID NO: 4406 - protein, 31 aa, Labidochromis caeruleus
VPTRLSPISILYIDSANNVVYKQYEDMVVES

SEQ ID NO: 4407 - protein, 31 aa, Oryctolagus cuniculus; identical to SEQ ID NO: 4332

SEQ ID NO: 4408 - protein, 31 aa, Ixodes scapularis
VPTELSPVSLLYVDAFERVVLKNYQDMVVEG

SEQ ID NO: 4409 - protein, 31 aa, Xenopus laevis; identical to SEQ ID NO: 4325

SEQ ID NO: 4410 - protein, 31 aa, Xenopus laevis; identical to SEQ ID NO: 4331

SEQ ID NO: 4411 - protein, 31 aa, Xenopus laevis; identical to SEQ ID NO: 4341

SEQ ID NO: 4412 - protein, 33 aa, Danio rerio; identical to SEQ ID NO: 4335

SEQ ID NO: 4413 - protein, 31 aa, Salmo salar; identical to SEQ ID NO: 4334

SEQ ID NO: 4414 - protein, 31 aa, Gadus morhua; identical to SEQ ID NO: 4334

SEQ ID NO: 4415 - protein, 31 aa, Bombyx mori
IPTQLSPISMLYMDEHNQVALKNYQDMMVMG

SEQ ID NO: 4416 - protein, 31 aa, Mus musculus; identical to SEQ ID NO: 4351

SEQ ID NO: 4417 - protein, 31 aa, Salmo salar
VPTELSPISLLYLDEYEKVILKNYQDMVVEG

SEQ ID NO: 4418 - protein, 34 aa, Bitis arietans
TSVGERTVELQVMQVTPKTLSSKIKVMKFREHTA

SEQ ID NO: 4419 - protein, 34 aa, Agkistrodon piscivorus piscivorus
TSTGKRSVGREIMRVDPHKETSKIEVMQFTEHTD

SEQ ID NO: 4420 - protein, 34 aa, Crotalus atrox
TATGKRSVGREIMRVDPRKGTSKIEVMQFTEHTE

SEQ ID NO: 4421 - protein, 33 aa, Agkistrodon piscivorus piscivorus
VPTELYNVTMEIMKLKPYQSQHIHPMSFQQHSK

SEQ ID NO: 4422 - protein, 33 aa, Vipera ammodytes ammodytes
VPTEVYNVTMEIMKLKPFQSQHIHPMSFQQHSK

SEQ ID NO: 4423 - protein, 34 aa, Protobothrops flavoviridis
TATGKHSVGREIMRVDPHKGTSKMEVMQFKEHTA

SEQ ID NO: 4424 - protein, 33 aa, Protobothrops flavoviridis; identical to SEQ ID NO: 4421

SEQ ID NO: 4425 - protein, 34 aa, Vipera ammodytes ammodytes
TPVGKHTVDLQIMRVNPRTQSSKMEVMKFTEHTA

SEQ ID NO: 4426 - protein, 34 aa, Daboia russelli russelli
TPVGKHTADIQIMRMNPRTHSSKMEVMKFMEHTA

SEQ ID NO: 4427 - protein, 33 aa, Osmerus mordax
TPTSTHNITMEIKRIKPQRQQNDIFMSFTEHNS

SEQ ID NO: 4428 - protein, 33 aa, Anoplopoma fimbria
QASLKSNITLEVMRIHPMISMHHVLLTFVEHQR

SEQ ID NO: 4429 - protein, 31 aa, Dasypus novemcinctus; identical to SEQ ID NO: 4332

SEQ ID NO: 4430 - protein, 31 aa, Myotis ricketti; identical to SEQ ID NO: 4341

SEQ ID NO: 4431 - protein, 31 aa, Danio rerio; identical to SEQ ID NO: 4323

SEQ ID NO: 4432 - protein, 31 aa, Danio rerio
IPTELSPISLLYLDEYEKVILKNYQDMVVEG

SEQ ID NO: 4433 - protein, 31 aa, Danio rerio; identical to SEQ ID NO: 4321

SEQ ID NO: 4434 - protein, 31 aa, Dama dama; identical to SEQ ID NO: 4341

SEQ ID NO: 4435 - protein, 31 aa, Danio rerio; identical to SEQ ID NO: 4406

SEQ ID NO: 4436 - protein, 33 aa, Xenopus laevis
VPTECYNITMQIMKIKPHISQHIMDMSFQQHSQ

SEQ ID NO: 4437 - protein, 33 aa, Xenopus laevis; identical to SEQ ID NO: 4436

SEQ ID NO: 4438 - protein, 31 aa, Oryctolagus cuniculus; identical to SEQ ID NO: 4341

SEQ ID NO: 4439 - protein, 31 aa, Oryctolagus cuniculus; identical to SEQ ID NO: 4325

SEQ ID NO: 4440 - protein, 31 aa, Danio rerio; identical to SEQ ID NO: 4432

SEQ ID NO: 4441 - protein, 31 aa, Danio rerio; identical to SEQ ID NO: 4323

SEQ ID NO: 4442 - protein, 33 aa, Danio rerio
VPTETRNVTMEVLRVKQRVSQHNFQLSFTEHTK

SEQ ID NO: 4443 - protein, 33 aa, Danio rerio; identical to SEQ ID NO: 4442

SEQ ID NO: 4444 - protein, 31 aa, Xenopus laevis; identical to SEQ ID NO: 4325

SEQ ID NO: 4445 - protein, 31 aa, Halocynthia roretzi
VPTELSPIAMLYVDECELVVLKTYQQMAVEG

SEQ ID NO: 4446 - protein, 33 aa, Ovis aries
VPTEEFNITMQIMRIKPHQSQHIGEMSFLQHNK

SEQ ID NO: 4447 - protein, 14 aa, Rattus norvegicus
VPTSESNVTMQTCK

SEQ ID NO: 4448 - protein, 31 aa, Danio rerio; identical to SEQ ID NO: 4432

SEQ ID NO: 4449 - protein, 31 aa, Gallus gallus
VPSKLSPISILYIDSGNNVVYKQYEDMVVET

SEQ ID NO: 4450 - protein, 31 aa, Branchiostoma floridae; identical to SEQ ID NO: 4399

SEQ ID NO: 4451 - protein, 31 aa, Crassostrea gigas
VPTELSSLSLLYTDEHGAVVLKVYQDMVVEG

SEQ ID NO: 4452 - protein, 31 aa, Drosophilia melanogaster; identical to SEQ ID NO: 4377

SEQ ID NO: 4453 - protein, 31 aa, Homo sapiens; identical to SEQ ID NO: 4341

SEQ ID NO: 4454 - protein, 31 aa, Homo sapiens; identical to SEQ ID NO: 4325

SEQ ID NO: 4455 - protein, 33 aa, Bos Taurus; identical to SEQ ID NO: 4446

SEQ ID NO: 4456 - protein, 33 aa, Bos Taurus; identical to SEQ ID NO: 4446

SEQ ID NO: 4457 - protein, 33 aa, Bos Taurus; identical to SEQ ID NO: 4330

SEQ ID NO: 4458 - protein, 33 aa, Bos Taurus; identical to SEQ ID NO: 4330

SEQ ID NO: 4459 - protein, 33 aa, Bos Taurus; identical to SEQ ID NO: 4330

SEQ ID NO: 4460 - protein, 33 aa, Bos Taurus; identical to SEQ ID NO: 4330

SEQ ID NO: 4461 - protein, 33 aa, Bos Taurus; identical to SEQ ID NO: 4330

SEQ ID NO: 4462 - protein, 33 aa, Bos Taurus; identical to SEQ ID NO: 4330

SEQ ID NO: 4463 - protein, 33 aa, Bos Taurus; identical to SEQ ID NO: 4330

SEQ ID NO: 4464 - protein, 33 aa, Bos Taurus; identical to SEQ ID NO: 4330

SEQ ID NO: 4465 - protein, 33 aa, Bos Taurus; identical to SEQ ID NO: 4330

SEQ ID NO: 4466 - protein, 33 aa, Bos Taurus; identical to SEQ ID NO: 4330

SEQ ID NO: 4467 - protein, 33 aa, Rattus norvegicus; identical to SEQ ID NO: 4391

SEQ ID NO: 4468 - protein, 33 aa, Rattus norvegicus; identical to SEQ ID NO: 4391

SEQ ID NO: 4469 - protein, 33 aa, Rattus norvegicus; identical to SEQ ID NO: 4391

SEQ ID NO: 4470 - protein, 33 aa, Rattus norvegicus; identical to SEQ ID NO: 4391

SEQ ID NO: 4471 - protein, 31 aa, Homo sapiens; identical to SEQ ID NO: 4333

SEQ ID NO: 4472 - protein, 31 aa, Mus musculus; identical to SEQ ID NO: 4370

SEQ ID NO: 4473 - protein, 31 aa, Mus musculus; identical to SEQ ID NO: 4341

SEQ ID NO: 4474 - protein, 31 aa, Mus musculus; identical to SEQ ID NO: 4325

SEQ ID NO: 4475 - protein, 31 aa, Homo sapiens; identical to SEQ ID NO: 4351

SEQ ID NO: 4476 - protein, 31 aa, Homo sapiens; identical to SEQ ID NO: 4370

SEQ ID NO: 4477 - protein, 31 aa, Mus musculus; identical to SEQ ID NO: 4333

SEQ ID NO: 4478 - protein, 31 aa, Xenopus laevis; identical to SEQ ID NO: 4341

SEQ ID NO: 4479 - protein, 33 aa, Cavia porcellus
VPTEEFNITMQIMRIKPHQGQHIGEMSFLQHSK

SEQ ID NO: 4480 - protein, 31 aa, Xenopus laevis; identical to SEQ ID NO: 4341

SEQ ID NO: 4481 - protein, 31 aa, Xenopus laevis; identical to SEQ ID NO: 4325

SEQ ID NO: 4482 - protein, 31 aa, Danio rerio
VPIKLSPISMLYYDNNDNVVLRHYEDMVVDE

SEQ ID NO: 4483 - protein, 31 aa, Homo sapiens; identical to SEQ ID NO: 4332

SEQ ID NO: 4484 - protein, 31 aa, Mus musculus; identical to SEQ ID NO: 4332

SEQ ID NO: 4485 - protein, 31 aa, Mus musculus; identical to SEQ ID NO: 4331

SEQ ID NO: 4486 - protein, 31 aa, Mus musculus
VPARLSPISILYIDAANNVVYKQYEDMVVEA

SEQ ID NO: 4487 - protein, 31 aa, Mus musculus; identical to SEQ ID NO: 4486

SEQ ID NO: 4488 - protein, 31 aa, Strongylocentrotus purpuratus
APTKLSPITVLYYDDSRNVVLKKYKNMVVRA

SEQ ID NO: 4489 - protein, 31 aa, Strongylocentrotus purpuratus; identical to SEQ ID NO: 4327

SEQ ID NO: 4490 - protein, 31 aa, Rattus norvegicus; identical to SEQ ID NO: 4341

SEQ ID NO: 4491 - protein, 31 aa, Mus musculus; identical to SEQ ID NO: 4351

SEQ ID NO: 4492 - protein, 33 aa, Sus scrofa; identical to SEQ ID NO: 4366

SEQ ID NO: 4493 - protein, 33 aa, Homo sapiens
VPVETANVTMQLLKIRSGDRPSYVELTFSQHVR

SEQ ID NO: 4494 - protein, 33 aa, Homo sapiens; identical to SEQ ID NO: 4493

SEQ ID NO: 4495 - protein, 33 aa, Homo sapiens; identical to SEQ ID NO: 4493

SEQ ID NO: 4496 - protein, 34 aa, Mus musculus
VPIKTANITMQILKIPPNRDPHFYVEMTFSQDVL

SEQ ID NO: 4497 - protein, 33 aa, Ovis aries; identical to SEQ ID NO: 4446

SEQ ID NO: 4498 - protein, 31 aa, Bos taurus
VPTKLTPISILYIDAGNNVVYNEYEEMVVES

SEQ ID NO: 4499 - protein, 33 aa, Protobothrops flavoviridis; identical to SEQ ID NO: 4421

SEQ ID NO: 4500 - protein, 33 aa, Protobothrops flavoviridis; identical to SEQ ID NO: 4421

SEQ ID NO: 4501 - protein, 33 aa, Protobothrops flavoviridis; identical to SEQ ID NO: 4421

SEQ ID NO: 4502 - protein, 34 aa, Daboia russelli russelli; identical to SEQ ID NO: 4426

SEQ ID NO: 4503 - protein, 34 aa, Protobothrops flavoviridis; identical to SEQ ID NO: 4423

SEQ ID NO: 4504 - protein, 34 aa, Vipera ammodytes ammodytes; identical to SEQ ID NO: 4425

SEQ ID NO: 4505 - protein, 33 aa, Gallus gallus
VPVDVYNVTMEIARIKPHQSQHIAHMSFLQHSK

SEQ ID NO: 4506 - protein, 33 aa, Coturnix coturnix japonica; identical to SEQ ID NO: 4505

SEQ ID NO: 4507 - protein, 33 aa, Coturnix coturnix japonica; identical to SEQ ID NO: 4505

SEQ ID NO: 4508 - protein, 33 aa, Coturnix coturnix japonica; identical to SEQ ID NO: 4505

SEQ ID NO: 4509 - protein, 33 aa, Coturnix coturnix japonica; identical to SEQ ID NO: 4505

SEQ ID NO: 4510 - protein, 34 aa, Macrovipera lebetina
TPVGKHTVDMQIMRVNPRTQSSKMEVMKFTEHTA

SEQ ID NO: 4511 - protein, 33 aa, Bitis gabonica
VPTEMYNVTMEVMKLKPFQSQHIHPVSFQQHSK

SEQ ID NO: 4512 - protein, 34 aa, Viper aspis aspis; identical to SEQ ID NO: 4425

SEQ ID NO: 4513 - protein, 31 aa, Danio rerio
VPTKLSPISILYIDSGNNVVYKQYEDMVVEQ

SEQ ID NO: 4514 - protein, 31 aa, Gallus gallus; identical to SEQ ID NO: 4351

SEQ ID NO: 4515 - protein, 31 aa, Drosophilia simulans; identical to SEQ ID NO: 4377

SEQ ID NO: 4516 - protein, 31 aa, Drosophilia virilis; identical to SEQ ID NO: 4383

SEQ ID NO: 4517 - protein, 33 aa, Mus musculus
VPTSESNITMQIMRIKPHQSQHIGEMSFLQHSR

SEQ ID NO: 4518 - protein, 33 aa, Mus musculus; identical to SEQ ID NO: 4517

SEQ ID NO: 4519 - protein, 33 aa, Mus musculus; identical to SEQ ID NO: 4517

SEQ ID NO: 4520 - protein, 40 aa, Mus musculus
VPTSESNITMQVGTCGTGDGAGAGGGRRTVVQGGALEGCL

SEQ ID NO: 4521 - protein, 31 aa, Rattus norvegicus; identical to SEQ ID NO: 4370

SEQ ID NO: 4522 - protein, 31 aa, Rattus norvegicus; identical to SEQ ID NO: 4325

SEQ ID NO: 4523 - protein, 33 aa, Xenopus tropicalis; identical to SEQ ID NO: 4355

SEQ ID NO: 4524 - protein, 31 aa, Nematostella vectensis; identical to SEQ ID NO: 4347

SEQ ID NO: 4525 - protein, 33 aa, Danio rerio; identical to SEQ ID NO: 4335

SEQ ID NO: 4526 - protein, 31 aa, Aedes aegypti; identical to SEQ ID NO: 4362

SEQ ID NO: 4527 - protein, 33 aa, Pantholops hodgsonii; identical to SEQ ID NO: 4446

SEQ ID NO: 4528 - protein, 33 aa, Danio rerio; identical to SEQ ID NO: 4335

SEQ ID NO: 4529 - protein, 33 aa, Danio rerio; identical to SEQ ID NO: 4335

SEQ ID NO: 4530 - protein, 31 aa, Saccoglossus kowalevskii
APTKLNAISVLYFDDSSNVILKKYRNMIVKS

SEQ ID NO: 4531 - protein, 31 aa, Saccoglossus kowalevskii
VPTDLSPISMLYLDEFDKVVLKNYQDMVVEG

SEQ ID NO: 4532 - protein, 31 aa, Drosophila yakuba; identical to SEQ ID NO: 4377

SEQ ID NO: 4533 - protein, 31 aa, Drosophila teissieri; identical to SEQ ID NO: 4377

SEQ ID NO: 4534 - protein, 31 aa, Drosophila orena; identical to SEQ ID NO: 4377

SEQ ID NO: 4535 - protein, 31 aa, Junonia coenia
VPTQLSSISMLYMDEVNNVVLKNYQDMMVVG

SEQ ID NO: 4536 - protein, 31 aa, Schistocerca Americana
IPTQLTSISMLYLDEESKVVLKNYHEMAVVG

SEQ ID NO: 4537 - protein, 31 aa, Nematostella vectensis; identical to SEQ ID NO: 4346

SEQ ID NO: 4538 - protein, 31 aa, Dama dama; identical to SEQ ID NO: 4325

SEQ ID NO: 4539 - protein, 31 aa, Bos taurus; identical to SEQ ID NO: 4325

SEQ ID NO: 4540 - protein, 31 aa, Eleutherodactylus coqui
VPTELSAISMLYLDEYDKVVLKNYQEMVVEA

SEQ ID NO: 4541 - protein, 31 aa, Homo sapiens; identical to SEQ ID NO: 4332

SEQ ID NO: 4542 - protein, 31 aa, Didelphis albiventris; identical to SEQ ID NO: 4325

SEQ ID NO: 4543 - protein, 31 aa, Platynereis dumerilii
VPTELSPISMLYVDEHDKVTLKNYQDMVVVG

SEQ ID NO: 4544 - protein, 32 aa, Nematostella vectensis; identical to SEQ ID NO: 4348

SEQ ID NO: 4545 - protein, 34 aa, Protobothrops mucrosquamatus
TATGKRSVGREVMRVDPHKGTSKIEVMQFKEHTA

SEQ ID NO: 4546 - protein, 33 aa, Anguilla japonica
VPVATRNVTLEVKRVKLHVTQHNFLLSFTEHTS

SEQ ID NO: 4547 - protein, 31 aa, Amphiura filiformis
VPTELSPISMLYLDEADKVVLKNYQDMVVEG

SEQ ID NO: 4548 - protein, 31 aa, Equus caballus; identical to SEQ ID NO: 4332

SEQ ID NO: 4549 - protein, 31 aa, Mus musculus; identical to SEQ ID NO: 4325

SEQ ID NO: 4550 - protein, 31 aa, Mus musculus; identical to SEQ ID NO: 4370

SEQ ID NO: 4551 - protein, 31 aa, Mus musculus; identical to SEQ ID NO: 4341

SEQ ID NO: 4552 - protein, 31 aa, Mus musculus; identical to SEQ ID NO: 4351

SEQ ID NO: 4553 - protein, 31 aa, Mus musculus; identical to SEQ ID NO: 4351

SEQ ID NO: 4554 - protein, 31 aa, Mus musculus; identical to SEQ ID NO: 4341

SEQ ID NO: 4555 - protein, 31 aa, Ciona intestinalis
VPTRLSSVSMLYLDKKDNVVLRLYEDMVVEA

SEQ ID NO: 4556 - protein, 31 aa, Homo sapiens; identical to SEQ ID NO: 4370

SEQ ID NO: 4557 - protein, 31 aa, Bos taurus; identical to SEQ ID NO: 4325

SEQ ID NO: 4558 - protein, 31 aa, Macaca fascicularis; identical to SEQ ID NO: 4351

SEQ ID NO: 4559 - protein, 34 aa, Tetraodon nigroviridis
HPTTTTNVTMQLLKIRPSEPHKEYVHMTFVEHQT

SEQ ID NO: 4560 - protein, 31 aa, Tetraodon nigroviridis; identical to SEQ ID NO: 4334

SEQ ID NO: 4561 - protein, 31 aa, Tetraodon nigroviridis; identical to SEQ ID NO: 4351

SEQ ID NO: 4562 - protein, 34 aa, Tetraodon nigroviridis
QPTLESNVTLQVIKIQQTVVSMHYVEITFVEHQR

SEQ ID NO: 4563 - protein, 31 aa, Tetraodon nigroviridis; identical to SEQ ID NO: 4513

SEQ ID NO: 4564 - protein, 33 aa, Tetraodon nigroviridis
VPAESRNVTLQLQRFRPRVIKEVVDLSFTEHVL

SEQ ID NO: 4565 - protein, 31 aa, Tetraodon nigroviridis
VPIRLSPISMLYYDNNDNVVLRHYQDMVVDE

SEQ ID NO: 4566 - protein, 33 aa, Orf virus
VPTEEANVTMQLMGASVSGGNGMQHLSFVEHKK

SEQ ID NO: 4567 - protein, 31 aa, Homo sapiens; identical to SEQ ID NO: 4370

SEQ ID NO: 4568 - protein, 31 aa, Homo sapiens; identical to SEQ ID NO: 4325

SEQ ID NO: 4569 - protein, 33 aa, Homo sapiens; identical to SEQ ID NO: 4493

SEQ ID NO: 4570 - protein, 33 aa, Gallus gallus; identical to SEQ ID NO: 4505

SEQ ID NO: 4571 - protein, 33 aa, Rattus norvegicus; identical to SEQ ID NO: 4391

SEQ ID NO: 4572 - protein, 34 aa, Mus musculus; identical to SEQ ID NO: 4496

SEQ ID NO: 4573 - protein, 31 aa, Xenopus laevis; identical to SEQ ID NO: 4341

SEQ ID NO: 4574 - protein, 31 aa, Amphiura filiformis
APTKLSAISMLYFDNDENVVLRQYEDMVVEA

SEQ ID NO: 4575 - protein, 33 aa, Homo sapiens; identical to SEQ ID NO: 4330

SEQ ID NO: 4576 - protein, 31 aa, Bos taurus; identical to SEQ ID NO: 4325

SEQ ID NO: 4577 - protein, 33 aa, Danio rerio; identical to SEQ ID NO: 4335

SEQ ID NO: 4578 - protein, 31 aa, Danio rerio; identical to SEQ ID NO: 4482

SEQ ID NO: 4579 - protein, 32 aa, Nematostella vectensis; identical to SEQ ID NO: 4348

SEQ ID NO: 4580 - protein, 34 aa, Rattus norvegicus
VALKTANITMQILKIPPNRDPHSYVEMTFSQDVL

SEQ ID NO: 4581 - protein, 33 aa, Rattus norvegicus; identical to SEQ ID NO: 4391

SEQ ID NO: 4582 - protein, 31 aa, Xenopus tropicalis
APTKLSPISMLYYDNNDNVVLRHYEDMVVDE

SEQ ID NO: 4583 - protein, 31 aa, Xenopus laevis; identical to SEQ ID NO: 4389

SEQ ID NO: 4584 - protein, 31 aa, Rattus norvegicus; identical to SEQ ID NO: 4325

SEQ ID NO: 4585 - protein, 31 aa, Trachemys scripta; identical to SEQ ID NO: 4341

SEQ ID NO: 4586 - protein, 33 aa, Oncohynchus mykiss
VPTETKNVTMEVIQVKQRVSQHHFLLSFTEHRK

SEQ ID NO: 4587 - protein, 33 aa, Oncorhynchus mykiss; identical to SEQ ID NO: 4586

SEQ ID NO: 4588 - protein, 31 aa, Rattus norvegicus; identical to SEQ ID NO: 4331

SEQ ID NO: 4589 - protein, 31 aa, Petromyzon marinus
VPTELSPISMLYMDEYEKVVLKNYQDMVVEG

SEQ ID NO: 4590 - protein, 31 aa, Petromyzon marinus
VPTELSPISMLYLDEYGKVVLKNYQDMVVEG

SEQ ID NO: 4591 - protein, 31 aa, Petromyzon marinus
IPTELTPIALLYLDEYEKVVLKNYQDMVVEG

SEQ ID NO: 4592 - protein, 34 aa, Bothrops erythromelas
TATGKRSVGREIMRLSPHKGTSEKEVMQFTEHTD

SEQ ID NO: 4593 - protein, 31 aa, Homo sapiens; identical to SEQ ID NO: 4331

SEQ ID NO: 4594 - protein, 31 aa, Xenopus tropicalis
APTQLNPISVLYFDDSSNVILKKYRNMVVRA

SEQ ID NO: 4595 - protein, 31 aa, Xenopus laevis; identical to SEQ ID NO: 4325

SEQ ID NO: 4596 - protein, 45 aa, Bovine popular stomatitis virus
VPTETSNVTMQLMVTSAHNGGSNDNGSGGGIGSGMREMSFLQHNK

SEQ ID NO: 4597 - protein, 31 aa, Equus caballus; identical to SEQ ID NO: 4325

SEQ ID NO: 4598 - protein, 41 aa, Bovine popular stomatitis virus
VPTETSNVTMQIMTTSAYNDGGTSGGISSGMREMSFLQHNK

SEQ ID NO: 4599 - protein, 37 aa, Homo sapiens
VPTEESNITMQVGIFGKWGKGGIGRGVTLWEQVVPGR

SEQ ID NO: 4600 - protein, 31 aa, Gallus gallus; identical to SEQ ID NO: 4341

SEQ ID NO: 4601 - protein, 33 aa, Mus musculus; identical to SEQ ID NO: 4517

SEQ ID NO: 4602 - protein, 31 aa, Paralichthys olivaceus; identical to SEQ ID NO: 4328

SEQ ID NO: 4603 - protein, 31 aa, Homo sapiens; identical to SEQ ID NO: 4486

SEQ ID NO: 4604 - protein, 31 aa, Athalia rosae
VPTALSSISMLYLDEENKVVLKNYQDMAVLG

SEQ ID NO: 4605 - protein, 33 aa, Orv virus strain D1701; identical to SEQ ID NO: 4566

SEQ ID NO: 4606 - protein, 31 aa, Tanganicodus irsacae; identical to SEQ ID NO: 4334

SEQ ID NO: 4607 - protein, 31 aa, Ophthalmotilapia nasuta; identical to SEQ ID NO: 4334

SEQ ID NO: 4608 - protein, 31 aa, Haplotaxodon microlepis; identical to SEQ ID NO: 4334

SEQ ID NO: 4609 - protein, 31 aa, Gnathochromis permaxillaris; identical to SEQ ID NO: 4334

SEQ ID NO: 4610 - protein, 31 aa, Anopheles gambiae; identical to SEQ ID NO: 4362

SEQ ID NO: 4611 - protein, 31 aa, Danio rerio; identical to SEQ ID NO: 4351

SEQ ID NO: 4612 - protein, 31 aa, Homo sapiens; identical to SEQ ID NO: 4486

SEQ ID NO: 4613 - protein, 31 aa, Tetraodon nigroviridis; identical to SEQ ID NO: 4328

SEQ ID NO: 4614 - protein, 31 aa, Takifugu rubripes
VPTDLSPISLLYLDEYEKVILKNYMDMVVEG

SEQ ID NO: 4615 - protein, 31 aa, Rattus norvegicus; identical to SEQ ID NO: 4325

SEQ ID NO: 4616 - protein, 33 aa, Oryctolagus cuniculus
VPTEEFNVTMQIMRIKPHQGQHIGEMSFLQHNK

SEQ ID NO: 4617 - protein, 31 aa, Parasteatoda tepidariorum
VPTELSPISMLYKDKFDNVVLKNYQDMVVEG

SEQ ID NO: 4618 - protein, 31 aa, Ilyanassa obsolete
VPTELSAISMLYLNERGKVQLKNYQDMVVEA

SEQ ID NO: 4619 - protein, 31 aa, Mus musculus; identical to SEQ ID NO: 4370

SEQ ID NO: 4620 - protein, 31 aa, Mus musculus; identical to SEQ ID NO: 4332

SEQ ID NO: 4621 - protein, 31 aa, Mus musculus; identical to SEQ ID NO: 4351

SEQ ID NO: 4622 - protein, 33 aa, Mustela vison; identical to SEQ ID NO: 4479

SEQ ID NO: 4623 - protein, 33 aa, Ovis aries
MPLETANVTMQLMKYHSLDQPFFVEMSFSQHVR

SEQ ID NO: 4624 - protein, 31 aa, Stichopus japonicas
VPTELDTLNMLYLNEKEQIILKNYKDMIVTS

SEQ ID NO: 4625 - protein, 31 aa, Boulengerochromis microlepis; identical to SEQ ID NO: 4334

SEQ ID NO: 4626 - protein, 31 aa, Talapia rendalli; identical to SEQ ID NO: 4334

SEQ ID NO: 4627 - protein, 31 aa, Tropheus duboisi; identical to SEQ ID NO: 4334

SEQ ID NO: 4628 - protein, 31 aa, Steatocranus casuarius; identical to SEQ ID NO: 4334

SEQ ID NO: 4629 - protein, 31 aa, Oreochromis niloticus; identical to SEQ ID NO: 4334

SEQ ID NO: 4630 - protein, 31 aa, Labidochromis caeruleus; identical to SEQ ID NO: 4334

SEQ ID NO: 4631 - protein, 31 aa, Julidochromis transcriptus; identical to SEQ ID NO: 4334

SEQ ID NO: 4632 - protein, 31 aa, Pundamilia nyererei; identical to SEQ ID NO: 4334

SEQ ID NO: 4633 - protein, 31 aa, Haplochromis burtoni; identical to SEQ ID NO: 4334

SEQ ID NO: 4634 - protein, 31 aa, Cyprichromis leptosome; identical to SEQ ID NO: 4334

SEQ ID NO: 4635 - protein, 31 aa, Ctenochromis horei; identical to SEQ ID NO: 4334

SEQ ID NO: 4636 - protein, 31 aa, Astatoreochromis alluaudi; identical to SEQ ID NO: 4334

SEQ ID NO: 4637 - protein, 31 aa, Suncus murinus; identical to SEQ ID NO: 4325

SEQ ID NO: 4638 - protein, 31 aa, Patella vulgata
VPSDLSAISMLYLDELDKVVLKNYQDMVVEG

SEQ ID NO: 4639 - protein, 31 aa, Acropora millepora
VPTTLEAISMLFMNEHSKVVLKNYQDMVVDG

SEQ ID NO: 4640 - protein, 31 aa, Hemicentrotus pulcherrimus; identical to SEQ ID NO: 4488

SEQ ID NO: 4641 - protein, 33 aa, Equus caballus
VPTAEFNITMQIMRIKPHQSQHIGEMSFLQHSK

SEQ ID NO: 4642 - protein, 33 aa, Sus scrofa; identical to SEQ ID NO: 4366

SEQ ID NO: 4643 - protein, 33 aa, Sus scrofa
VPTEEFNIAMQIMRIKPHQGQHIGEMSFLQHNK

SEQ ID NO: 4644 - protein, 31 aa, Archaster typicus
VPTDLSAISMLYLDDSDSVILRNYQDMVVEG

SEQ ID NO: 4645 - protein, 31 aa, Gallus gallus
VPVRLSPISILYYDNSDNVVLRHYEDMVVDE

SEQ ID NO: 4646 - protein, 31 aa, Gallus gallus; identical to SEQ ID NO: 4341

SEQ ID NO: 4647 - protein, 31 aa, Gallus gallus; identical to SEQ ID NO: 4325

SEQ ID NO: 4648 - protein, 34 aa, Bothrops jararaca; identical to SEQ ID NO: 4592

SEQ ID NO: 4649 - protein, 34 aa, Bothrops insularis
TATGKRSVGREIMRVDPHKGTSKTEVMQFTEHTD

SEQ ID NO: 4650 - protein, 31 aa, Lampetra japonica; identical to SEQ ID NO: 4590

SEQ ID NO: 4651 - protein, 31 aa, Lampetra japonica; identical to SEQ ID NO: 4591

SEQ ID NO: 4652 - protein, 31 aa, Xenopus tropicalis; identical to SEQ ID NO: 4354

SEQ ID NO: 4653 - protein, 31 aa, Xenopus tropicalis; identical to SEQ ID NO: 4341

SEQ ID NO: 4654 - protein, 31 aa, Gallus gallus; identical to SEQ ID NO: 4333

SEQ ID NO: 4655 - protein, 31 aa, Xenopus laevis; identical to SEQ ID NO: 4325

SEQ ID NO: 4656 - protein, 33 aa, Felis catus; identical to SEQ ID NO: 4479

SEQ ID NO: 4657 - protein, 33 aa, Macaca fascicularis; identical to SEQ ID NO: 4330

SEQ ID NO: 4658 - protein, 31 aa, Schistocerca gregaria
VPTQLTSISMLYLDEESKVVLKNYHEMAVVG

SEQ ID NO: 4659 - protein, 31 aa, Gallus Gallus; identical to SEQ ID NO: 4645

SEQ ID NO: 4660 - protein, 33 aa, Mesocricetus auratus
VPTSESNITMQIMRVKPHQSQHIGEMSFLQHSR

SEQ ID NO: 4661 - protein, 33 aa, Macaca mulatta; identical to SEQ ID NO: 4330

SEQ ID NO: 4662 - protein, 31 aa, Chlorocebus aethiops; identical to SEQ ID NO: 4486

SEQ ID NO: 4663 - protein, 31 aa, Macaca fascicularis; identical to SEQ ID NO: 4486

SEQ ID NO: 4664 - protein, 31 aa, Xenopus laevis
VPSKLSPISILYIDSGNNVVYKQYEDMVVES

SEQ ID NO: 4665 - protein, 33 aa, Mesocricetus auratus; identical to SEQ ID NO: 4660

SEQ ID NO: 4666 - protein, 33 aa, Callithrix jacchus; identical to SEQ ID NO: 4366

SEQ ID NO: 4667 - protein, 33 aa, Equus caballus; identical to SEQ ID NO: 4641

SEQ ID NO: 4668 - protein, 31 aa, Gallus gallus; identical to SEQ ID NO: 4333

SEQ ID NO: 4669 - protein, 33 aa, Canis familiaris; identical to SEQ ID NO: 4479

SEQ ID NO: 4670 - protein, 33 aa, Canis familiaris; identical to SEQ ID NO: 4479

SEQ ID NO: 4671 - protein, 33 aa, Canis familiaris; identical to SEQ ID NO: 4479

SEQ ID NO: 4672 - protein, 33 aa, Ovis aries; identical to SEQ ID NO: 4446

SEQ ID NO: 4673 - protein, 31 aa, Canis familiaris; identical to SEQ ID NO: 4325

SEQ ID NO: 4674 - protein, 31 aa, Danio rerio
APTQLHGISVLYFDDSSNVILKKYRNMVVRA

SEQ ID NO: 4675 - protein, 33 aa, Spalax ehrenbergi
VPTSESNITMQIMRIKPHQSQHIGEMSFLQHNR

SEQ ID NO: 4676 - protein, 31 aa, Branchiostoma belcheri; identical to SEQ ID NO: 4399

SEQ ID NO: 4677 - protein, 31 aa, Ptychodera flava
VPTELSPISMLYLDEYDKVILKNYQEMVVEG

SEQ ID NO: 4678 - protein, 31 aa, Danio rerio; identical to SEQ ID NO: 4664

SEQ ID NO: 4679 - protein, 31 aa, Gallus gallus; identical to SEQ ID NO: 4332

SEQ ID NO: 4680 - protein, 31 aa, Xenopus laevis; identical to SEQ ID NO: 4331

SEQ ID NO: 4681 - protein, 33 aa, Bos taurus
VPLETANVTMQLMKYRSLDQPFFVEMSFSQHVR

SEQ ID NO: 4682 - protein, 31 aa, Lytechinus variegatus
GPTELSAISMLYLDEYEKVVLKNYQDMVVEG

SEQ ID NO: 4683 - protein, 31 aa, Strongylocentrotus purpuratus; identical to SEQ ID NO: 4326

SEQ ID NO: 4684 - protein, 31 aa, Tripneustes gratilla; identical to SEQ ID NO: 4326

SEQ ID NO: 4685 - protein, 31 aa, Xenopus laevis; identical to SEQ ID NO: 4333

SEQ ID NO: 4686 - protein, 31 aa, Xenopus laevis; identical to SEQ ID NO: 4582

SEQ ID NO: 4687 - protein, 33 aa, Orf virus; identical to SEQ ID NO: 4566

SEQ ID NO: 4688 - protein, 4 aa, Gymnema sylvestre
EPLE

SEQ ID NO: 4689 - protein, 3 aa, Acrocinus longimanus
SRY

SEQ ID NO: 4690 - protein, 3 aa, Acrocinus longimanus
SGY

SEQ ID NO: 4691 - protein, 3 aa, Acrocinus longimanus
SGY

SEQ ID NO: 4692 - protein, 4 aa, Pimpla hypochondriaca
EGLV

SEQ ID NO: 4693 - protein, 2 aa, Pimpla hypochondriaca
GV

SEQ ID NO: 4694 - protein, 6 aa, Lysiphlebus testaceipes
FTKLFR

SEQ ID NO: 4695 - protein, 3 aa, Bemisia tabaci
SGY

SEQ ID NO: 4696 - protein, 3 aa, Bemisia tabaci
SGF

SEQ ID NO: 4697 - protein, 3 aa, Bemisia tabaci
SGF

SEQ ID NO: 4698 - protein, 3 aa, Bemisia tabaci
TTF

SEQ ID NO: 4699 - protein, 3 aa, Bradysia hygida
SGF

SEQ ID NO: 4700 - protein, 2 aa, Solanum lycopersicum
QF

SEQ ID NO: 4701 - protein, 2 aa, Solanum lycopersicum
QA

SEQ ID NO: 4702 - protein, 2 aa, Solanum tuberosum
QA

SEQ ID NO: 4703 - protein, 2 aa, Solanum tuberosum
PW

SEQ ID NO: 4704 - protein, 2 aa, Solanum tuberosum
PW

SEQ ID NO: 4705 - protein, 2 aa, Solanum tuberosum
PW

SEQ ID NO: 4706 - protein, 2 aa, Solanum tuberosum
PW

SEQ ID NO: 4707 - protein, 2 aa, Solanum tuberosum
PW

SEQ ID NO: 4708 - protein, 2 aa, Solanum tuberosum
PW

SEQ ID NO: 4709 - protein, 2 aa, Solanum tuberosum
PW

SEQ ID NO: 4710 - protein, 2 aa, Solanum brevidens
QW

SEQ ID NO: 4711 - protein, 2 aa, Solanum tuberosum
QA

SEQ ID NO: 4712 - protein, 2 aa, Hyoscyamus niger
YN

SEQ ID NO: 4713 - protein, 3 aa, Musca domestica
TKR

SEQ ID NO: 4714 - protein, 3 aa, Aedes aegypti
SGS

SEQ ID NO: 4715 - protein, 3 aa, Aedes aegypti
SGS

SEQ ID NO: 4716 - protein, 3 aa, Anopheles gambiae
SGS

SEQ ID NO: 4717 - protein, 3 aa, Mesembryanthemum crystallinum
SGF

SEQ ID NO: 4718 - protein, 3 aa, Mirabilis jalapa
SGF

SEQ ID NO: 4719 - protein, 3 aa, Mirabilis jalapa
SGF

SEQ ID NO: 4720 - protein, 3 aa, Phytolacca Americana
SSY

SEQ ID NO: 4721 - protein, 3 aa, Phytolacca Americana
SSY

SEQ ID NO: 4722 - protein, 3 aa, Phytolacca Americana
SNY

SEQ ID NO: 4723 - protein, 10 aa, Petunia hybrid
CKKAKFSDGH

SEQ ID NO: 4724 - protein, 12 aa, Petunia hybrid
CKAQPEKFTDGH

SEQ ID NO: 4725 - protein, 1 aa, Pisum sativum
R

SEQ ID NO: 4726 - protein, 1 aa, Pisum sativum
R

SEQ ID NO: 4727 - protein, 1 aa, Pisum sativum
R

SEQ ID NO: 4728 - protein, 1 aa, Pisum sativum
R

SEQ ID NO: 4729 - protein, 1 aa, Pisum sativum
R

SEQ ID NO: 4730 - protein, 1 aa, Pisum sativum
R

SEQ ID NO: 4731 - protein, 1 aa, Glycine soja
R

SEQ ID NO: 4732 - protein, 1 aa, Phaseolus angularis
L

SEQ ID NO: 4733 - protein, 1 aa, Phaseolus angularis
R

SEQ ID NO: 4734 - protein, 1 aa, Glycine max
R

SEQ ID NO: 4735 - protein, 1 aa, Medicago truncatula
I

SEQ ID NO: 4736 - protein, 1 aa, Medicago truncatula
R

SEQ ID NO: 4737 - protein, 1 aa, Medicago truncatula
I

SEQ ID NO: 4738 - protein, 1 aa, Vicia hirsute
R

SEQ ID NO: 4739 - protein, 1 aa, Trigonella foenum-graecum
R

SEQ ID NO: 4740 - protein, 1 aa, Onobrychis viciifolia
R

SEQ ID NO: 4741 - protein, 1 aa, Mundulea sericea
R

SEQ ID NO: 4742 - protein, 1 aa, Melilotus alba
R

SEQ ID NO: 4743 - protein, 1 aa, Philenoptera violacea
R

SEQ ID NO: 4744 - protein, 1 aa, Canavalia brasiliensis
R

SEQ ID NO: 4745 - protein, 1 aa, Bituminaria bituminosa
R

SEQ ID NO: 4746 - protein, 1 aa, Bituminaria bituminosa
R

SEQ ID NO: 4747 - protein, 1 aa, Bituminaria bituminosa
R

SEQ ID NO: 4748 - protein, 1 aa, Phaseolus vulgaris
R

SEQ ID NO: 4749 - protein, 1 aa, Glycine max
R

SEQ ID NO: 4750 - protein, 1 aa, Medicago truncatula
R

SEQ ID NO: 4751 - protein, 6 aa, Mesobuthus martensii
CGGIGK

SEQ ID NO: 4752 - protein, 6 aa, Mesobuthus martensii
CGGNGK

SEQ ID NO: 4753 - protein, 7 aa, Mesobuthus tamulus
CGRKGGV

SEQ ID NO: 4754 - protein, 6 aa, Mesobuthus eupeus
CKGRGK

SEQ ID NO: 4755 - protein, 8 aa, Buthus sindicus
CGGKGKGK

SEQ ID NO: 4756 - protein, 6 aa, Leiurus quinquestratus hebraeus
CGGIGK

SEQ ID NO: 4757 - protein, 7 aa, Mesobuthus eupeus
CGGRGRK

SEQ ID NO: 4758 - protein, 6 aa, Mesobuthus tamulus
CGGRGY

SEQ ID NO: 4759 - protein, 6 aa, Mesobuthus eupeus
CGGNGK

SEQ ID NO: 4760 - protein, 6 aa, Mesobuthus eupeus
CGGNGK

SEQ ID NO: 4761 - protein, 8 aa, Leiurus quinquestratus hebraeus
CGGKGKGK

SEQ ID NO: 4762 - protein, 6 aa, Buthus sindicus
CGGIGR

SEQ ID NO: 4763 - protein, 8 aa, Leiurus quinquestratus quinquestratus
CGGKGRGK

SEQ ID NO: 4764 - protein, 6 aa, Mesobuthus eupeus
CGGRGK

SEQ ID NO: 4765 - protein, 6 aa, Mesobuthus eupeus
CGGGKK

SEQ ID NO: 4766 - protein, 3 aa, Pandinus imperator
GKK

SEQ ID NO: 4767 - protein, 3 aa, Opistophthalmus carinatus
SKK

SEQ ID NO: 4768 - protein, 3 aa, Opistophthalmus carinatus
SKK

SEQ ID NO: 4769 - protein, 5 aa, Mesobuthus martensii
RYGER

SEQ ID NO: 4770 - protein, 3 aa, Scorpio maurus palmatus
SKK

SEQ ID NO: 4771 - protein, 10 aa, Centruroides noxius
CKNAGHNGGT

SEQ ID NO: 4772 - protein, 10 aa, Centruroides elegans
CKKYGHNGGT

SEQ ID NO: 4773 - protein, 10 aa, Centruroides gracilis
CKKYGHNGGT

SEQ ID NO: 4774 - protein, 10 aa, Centruroides sculpturatus
CKKAGHNGGT

SEQ ID NO: 4775 - protein, 10 aa, Centruroides limpidus limpidus
CKKAGHNGGT

SEQ ID NO: 4776 - protein, 10 aa, Centruroides exilicauda
CKKAGHSGGT

SEQ ID NO: 4777 - protein, 10 aa, Centruroides noxius
CKKAGHKGGT

SEQ ID NO: 4778 - protein, 10 aa, Centruroides elegans
CKKAGHRGGT

SEQ ID NO: 4779 - protein, 10 aa, Centruroides sculpturatus
CKKAGHRGGT

SEQ ID NO: 4780 - protein, 10 aa, Centruroides gracilis
CKKAGHNKGT

SEQ ID NO: 4781 - protein, 10 aa, Centruroides limpidus limpidus
CKKAGDRAGN

SEQ ID NO: 4782 - protein, 10 aa, Centruroides noxius
CKNAGHNGGT

SEQ ID NO: 4783 - protein, 10 aa, Centruroides exilicauda
CKKAGDRAGI

SEQ ID NO: 4784 - protein, 10 aa, Centruroides exilicauda
CKKAGDRAGT

SEQ ID NO: 4785 - protein, 10 aa, Centruroides exilicauda
CKKAGDRAGT

SEQ ID NO: 4786 - protein, 10 aa, Centruroides limpidus limpidus
CKKAGDRAGN

SEQ ID NO: 4787 - protein, 10 aa, Centruroides limpidus limpidus
CKKAGDRAGN

SEQ ID NO: 4788 - protein, 10 aa, Centruroides elegans
CKKAGDRAGN

SEQ ID NO: 4789 - protein, 10 aa, Centruroides sculpturatus
CKKAGDRAGT

SEQ ID NO: 4790 - protein, 10 aa, Centruroides sculpturatus
CKKAGDRAGT

SEQ ID NO: 4791 - protein, 10 aa, Centruroides sculpturatus
CKKAGERVGT

SEQ ID NO: 4792 - protein, 10 aa, Centruroides sculpturatus
CKKAGDRAGT

SEQ ID NO: 4793 - protein, 10 aa, Centruroides sculpturatus
CKKAGDRAGT

SEQ ID NO: 4794 - protein, 10 aa, Centruroides sculpturatus
CKKAGHNGGT

SEQ ID NO: 4795 - protein, 10 aa, Centruroides gracilis
CKKAGHTGGT

SEQ ID NO: 4796 - protein, 1 aa, Momordica charantia
I

SEQ ID NO: 4797 - protein, 1 aa, Momordica charantia
I

SEQ ID NO: 4798 - protein, 1 aa, Lagenaria siceraria
V

SEQ ID NO: 4799 - protein, 1 aa, Citrullus lanatus
V

SEQ ID NO: 4800 - protein, 1 aa, Cucurbita maxima
V

SEQ ID NO: 4801 - protein, 1 aa, Luffa cylindrical
I

SEQ ID NO: 4802 - protein, 1 aa, Momordica charantia
I

SEQ ID NO: 4803 - protein, 1 aa, Momordica cochinchinensis
I

SEQ ID NO: 4804 - protein, 1 aa, Momordica repens
V

SEQ ID NO: 4805 - protein, 1 aa, Momordica repens
K

SEQ ID NO: 4806 - protein, 1 aa, Trichosanthes kirilowii
V

SEQ ID NO: 4807 - protein, 1 aa, Cucumis sativus
V

SEQ ID NO: 4808 - protein, 1 aa, Bryonia dioica
V

SEQ ID NO: 4809 - protein, 1 aa, Ecballium elaterium
I

SEQ ID NO: 4810 - protein, 1 aa, Luffa cylindrical
I

SEQ ID NO: 4811 - protein, 1 aa, Momordocia charantia
I

SEQ ID NO: 4812 - protein, 1 aa, Momordocia cochinchinensis
T

SEQ ID NO: 4813 - protein, 1 aa, Sechium edule
V

SEQ ID NO: 4814 - protein, 1 aa, Cucumis melo
I

SEQ ID NO: 4815 - protein, 1 aa, Cucurbita pepo
I

SEQ ID NO: 4816 - protein, 1 aa, Cyclanthera pedata
I

SEQ ID NO: 4817 - protein, 1 aa, Luffa cylindrical
I

SEQ ID NO: 4818 - protein, 1 aa, Momordica charantia
I

SEQ ID NO: 4819 - protein, 1 aa, Momordica cochinchinensis
V

SEQ ID NO: 4820 - protein, 1 aa, Cucurbita maxima
V

SEQ ID NO: 4821 - protein, 1 aa, Cucumis sativus
I

SEQ ID NO: 4822 - protein, 1 aa, Luffa cylindrical
I

SEQ ID NO: 4823 - protein, 1 aa, Cyclanthera pedata
I

SEQ ID NO: 4824 - protein, 1 aa, Luffa cylindrical
R

SEQ ID NO: 4825 - protein, 1 aa, Sechium edule
T

SEQ ID NO: 4826 - protein, 1 aa, Cyclanthera pedata
I

SEQ ID NO: 4827 - protein, 1 aa, Cyclanthera pedata
I

SEQ ID NO: 4828 - protein, 1 aa, Momordica charantia
I

SEQ ID NO: 4829 - protein, 1 aa, Cucumis melo
T

SEQ ID NO: 4830 - protein, 1 aa, Cucumis melo
V

SEQ ID NO: 4831 - protein, 1 aa, Cucumis melo
V

SEQ ID NO: 4832 - protein, 3 aa, Mirabilis jalapa
SGS

SEQ ID NO: 4833 - protein, 3 aa, Spinacia oleracea
SGA

SEQ ID NO: 4834 - protein, 3 aa, Spinacia oleracea
SGA

SEQ ID NO: 4835 - protein, 3 aa, Spinacia oleracea
SGA

SEQ ID NO: 4836 - protein, 10 aa, Ancylometes
LDNLFFKRPY

SEQ ID NO: 4837 - protein, 3 aa, Atrax robustus
SGS

SEQ ID NO: 4838 - protein, 3 aa, Atrax robustus
SGS

SEQ ID NO: 4839 - protein, 3 aa, Atrax robustus
SQS

SEQ ID NO: 4840 - protein, 3 aa, Atrax robustus
SKS

SEQ ID NO: 4841 - protein, 3 aa, Atrax robustus
SQS

SEQ ID NO: 4842 - protein, 4 aa, Lycosa kazakhstanicus
FPWS

SEQ ID NO: 4843 - protein, 4 aa, Lycosa kazakhstanicus
FPWS

SEQ ID NO: 4844 - protein, 4 aa, Lycosa kazakhstanicus
FPWS

SEQ ID NO: 4845 - protein, 4 aa, Lycosa kazakhstanicus
FPWS

SEQ ID NO: 4846 - protein, 4 aa, Lycosa kazakhstanicus
FPWT

SEQ ID NO: 4847 - protein, 4 aa, Lycosa kazakhstanicus
FPWS

SEQ ID NO: 4848 - protein, 4 aa, Lycosa kazakhstanicus
FPWS

SEQ ID NO: 4849 - protein, 4 aa, Grammostola rosea
EDMV

SEQ ID NO: 4850 - protein, 4 aa, Grammostola rosea
EGLV

SEQ ID NO: 4851 - protein, 4 aa, Chilobrachys juingzhao
AHLG

SEQ ID NO: 4852 - protein, 4 aa, Chilobrachys juingzhao
KGYA

SEQ ID NO: 4853 - protein, 4 aa, Chilobrachys juingzhao
EHLG

SEQ ID NO: 4854 - protein, 4 aa, Chilobrachys juingzhao
SGYN

SEQ ID NO: 4855 - protein, 4 aa, Chilobrachys juingzhao
SGYN

SEQ ID NO: 4856 - protein, 4 aa, Chilobrachys juingzhao
GRLE

SEQ ID NO: 4857 - protein, 4 aa, Chilobrachys juingzhao
GRLE

SEQ ID NO: 4858 - protein, 4 aa, Chilobrachys juingzhao
GRLE

SEQ ID NO: 4859 - protein, 4 aa, Chilobrachys juingzhao
RPLV

SEQ ID NO: 4860 - protein, 2 aa, Chilobrachys juingzhao
GS

SEQ ID NO: 4861 - protein, 4 aa, Chilobrachys juingzhao
EGYV

SEQ ID NO: 4862 - protein, 4 aa, Chilobrachys juingzhao
EGYV

SEQ ID NO: 4863 - protein, 4 aa, Chilobrachys juingzhao
ANFA

SEQ ID NO: 4864 - protein, 4 aa, Chilobrachys juingzhao
ANFA

SEQ ID NO: 4865 - protein, 4 aa, Chilobrachys juingzhao
DNFS

SEQ ID NO: 4866 - protein, 4 aa, Chilobrachys juingzhao
SGLA

SEQ ID NO: 4867 - protein, 4 aa, Chilobrachys juingzhao
SGLA

SEQ ID NO: 4868 - protein, 4 aa, Chilobrachys juingzhao
SGYN

SEQ ID NO: 4869 - protein, 4 aa, Chilobrachys juingzhao
SGYN

SEQ ID NO: 4870 - protein, 4 aa, Chilobrachys juingzhao
SGFN

SEQ ID NO: 4871 - protein, 4 aa, Chilobrachys juingzhao
SGFN

SEQ ID NO: 4872 - protein, 4 aa, Chilobrachys juingzhao
SGYD

SEQ ID NO: 4873 - protein, 4 aa, Chilobrachys juingzhao
SGYD

SEQ ID NO: 4874 - protein, 4 aa, Chilobrachys juingzhao
SGYD

SEQ ID NO: 4875 - protein, 4 aa, Chilobrachys juingzhao
SSYV

SEQ ID NO: 4876 - protein, 4 aa, Chilobrachys juingzhao
SSYV

SEQ ID NO: 4877 - protein, 4 aa, Chilobrachys juingzhao
SSYV

SEQ ID NO: 4878 - protein, 4 aa, Chilobrachys juingzhao
SGYY

SEQ ID NO: 4879 - protein, 4 aa, Chilobrachys juingzhao
PKYV

SEQ ID NO: 4880 - protein, 4 aa, Chilobrachys juingzhao
PKYV

SEQ ID NO: 4881 - protein, 4 aa, Chilobrachys juingzhao
AHLA

SEQ ID NO: 4882 - protein, 4 aa, Chilobrachys juingzhao
AHLA

SEQ ID NO: 4883 - protein, 4 aa, Chilobrachys juingzhao
AHLG

SEQ ID NO: 4884 - protein, 4 aa, Chilobrachys juingzhao
AHLG

SEQ ID NO: 4885 - protein, 4 aa, Chilobrachys juingzhao
AHLG

SEQ ID NO: 4886 - protein, 4 aa, Chilobrachys juingzhao
AHLG

SEQ ID NO: 4887 - protein, 4 aa, Chilobrachys juingzhao
AHLG

SEQ ID NO: 4888 - protein, 4 aa, Chilobrachys juingzhao
AHLG

SEQ ID NO: 4889 - protein, 4 aa, Chilobrachys juingzhao
ETFH

SEQ ID NO: 4890 - protein, 4 aa, Chilobrachys juingzhao
ETFH

SEQ ID NO: 4891 - protein, 4 aa, Chilobrachys juingzhao
ETFH

SEQ ID NO: 4892 - protein, 4 aa, Chilobrachys juingzhao
EAFH

SEQ ID NO: 4893 - protein, 4 aa, Chilobrachys juingzhao
QRLY

SEQ ID NO: 4894 - protein, 4 aa, Chilobrachys juingzhao
EGRK

SEQ ID NO: 4895 - protein, 4 aa, Chilobrachys juingzhao
EGRK

SEQ ID NO: 4896 - protein, 4 aa, Chilobrachys juingzhao
PHLG

SEQ ID NO: 4897 - protein, 4 aa, Chilobrachys juingzhao
PHLG

SEQ ID NO: 4898 - protein, 4 aa, Chilobrachys juingzhao
PHLG

SEQ ID NO: 4899 - protein, 4 aa, Chilobrachys juingzhao
EHLV

SEQ ID NO: 4900 - protein, 4 aa, Chilobrachys juingzhao
AHLE

SEQ ID NO: 4901 - protein, 4 aa, Chilobrachys juingzhao
KHLA

SEQ ID NO: 4902 - protein, 4 aa, Chilobrachys juingzhao
KHLA

SEQ ID NO: 4903 - protein, 4 aa, Chilobrachys juingzhao
EHLG

SEQ ID NO: 4904 - protein, 4 aa, Chilobrachys juingzhao
EHLG

SEQ ID NO: 4905 - protein, 4 aa, Chilobrachys juingzhao
EHLG

SEQ ID NO: 4906 - protein, 4 aa, Chilobrachys juingzhao
EHLG

SEQ ID NO: 4907 - protein, 4 aa, Chilobrachys juingzhao
EHLG

SEQ ID NO: 4908 - protein, 4 aa, Chilobrachys juingzhao
EHLG

SEQ ID NO: 4909 - protein, 4 aa, Chilobrachys juingzhao
EHLG

SEQ ID NO: 4910 - protein, 4 aa, Chilobrachys juingzhao
EHLR

SEQ ID NO: 4911 - protein, 4 aa, Chilobrachys juingzhao
SGFR

SEQ ID NO: 4912 - protein, 4 aa, Chilobrachys juingzhao
SGFR

SEQ ID NO: 4913 - protein, 4 aa, Chilobrachys juingzhao
AHLG

SEQ ID NO: 4914 - protein, 4 aa, Chilobrachys juingzhao
PGYK

SEQ ID NO: 4915 - protein, 4 aa, Chilobrachys juingzhao
SGAP

SEQ ID NO: 4916 - protein, 4 aa, Chilobrachys juingzhao
SGAP

SEQ ID NO: 4917 - protein, 4 aa, Chilobrachys juingzhao
SGAP

SEQ ID NO: 4918 - protein, 4 aa, Chilobrachys juingzhao
SPLK

SEQ ID NO: 4919 - protein, 4 aa, Chilobrachys juingzhao
PPLK

SEQ ID NO: 4920 - protein, 4 aa, Chilobrachys juingzhao
IGLQ

SEQ ID NO: 4921 - protein, 4 aa, Chilobrachys juingzhao
RYLG

SEQ ID NO: 4922 - protein, 10 aa, Chilobrachys juingzhao
DKNCSDTFWT

SEQ ID NO: 4923 - protein, 3 aa, Calisoga sp
SGN

SEQ ID NO: 4924 - protein, 3 aa, Calisoga sp
SGN

SEQ ID NO: 4925 - protein, 3 aa, Calisoga sp
SGS

SEQ ID NO: 4926 - protein, 3 aa, Ctenus ornatus
HGT

SEQ ID NO: 4927 - protein, 4 aa, Chilobrachys juingzhao
AHLG

SEQ ID NO: 4928 - protein, 4 aa, Chilobrachys juingzhao
EGYV

SEQ ID NO: 4929 - protein, 4 aa, Chilobrachys juingzhao
ANFA

SEQ ID NO: 4930 - protein, 4 aa, Chilobrachys juingzhao
KGYA

SEQ ID NO: 4931 - protein, 4 aa, Chilobrachys juingzhao
EGLR

SEQ ID NO: 4932 - protein, 4 aa, Chilobrachys juingzhao
SGYN

SEQ ID NO: 4933 - protein, 4 aa, Grammostoal rosea
EGLV

SEQ ID NO: 4934 - protein, 5 aa, Grammostoal rosea
RPKLK

SEQ ID NO: 4935 - protein, 4 aa, Agelena orientalis
SGLT

SEQ ID NO: 4936 - protein, 4 aa, Agelena orientalis
DGYY

SEQ ID NO: 4937 - protein, 4 aa, Agelena orientalis
DGFY

SEQ ID NO: 4938 - protein, 4 aa, Agelena orientalis
SGYY

SEQ ID NO: 4939 - protein, 4 aa, Agelena orientalis
SGYY

SEQ ID NO: 4940 - protein, 4 aa, Agelena orientalis
SGYY

SEQ ID NO: 4941 - protein, 4 aa, Agelena orientalis
KGYY

SEQ ID NO: 4942 - protein, 4 aa, Agelena orientalis
KGYY

SEQ ID NO: 4943 - protein, 4 aa, Agelena orientalis
KGYY

SEQ ID NO: 4944 - protein, 4 aa, Agelena orientalis
SGYY

SEQ ID NO: 4945 - protein, 4 aa, Agelena orientalis
SGYY

SEQ ID NO: 4946 - protein, 4 aa, Agelena orientalis
SGYY

SEQ ID NO: 4947 - protein, 4 aa, Agelena orientalis
SGYY

SEQ ID NO: 4948 - protein, 4 aa, Agelena orientalis
EGLY

SEQ ID NO: 4949 - protein, 4 aa, Agelena orientalis
DGWR

SEQ ID NO: 4950 - protein, 4 aa, Agelena orientalis
SGLR

SEQ ID NO: 4951 - protein, 4 aa, Agelena orientalis
SGLT

SEQ ID NO: 4952 - protein, 4 aa, Agelena orientalis
SGLT

SEQ ID NO: 4953 - protein, 4 aa, Agelena orientalis
SGLT

SEQ ID NO: 4954 - protein, 4 aa, Agelena orientalis
SGLT

SEQ ID NO: 4955 - protein, 4 aa, Agelena orientalis
SGLT

SEQ ID NO: 4956 - protein, 4 aa, Agelena orientalis
SGLK

SEQ ID NO: 4957 - protein, 4 aa, Agelena orientalis
SRLR

SEQ ID NO: 4958 - protein, 4 aa, Agelena orientalis
SGLK

SEQ ID NO: 4959 - protein, 4 aa, Agelena orientalis
TGLK

SEQ ID NO: 4960 - protein, 4 aa, Agelena orientalis
SGLR

SEQ ID NO: 4961 - protein, 4 aa, Agelena orientalis
SGLK

SEQ ID NO: 4962 - protein, 4 aa, Agelena orientalis
SGLR

SEQ ID NO: 4963 - protein, 4 aa, Agelena orientalis
SGLR

SEQ ID NO: 4964 - protein, 4 aa, Agelena orientalis
SRLK

SEQ ID NO: 4965 - protein, 4 aa, Agelena orientalis
SGLR

SEQ ID NO: 4966 - protein, 4 aa, Agelena orientalis
SGLK

SEQ ID NO: 4967 - protein, 4 aa, Agelena orientalis
SGLR

SEQ ID NO: 4968 - protein, 4 aa, Segestria florentina
GSCL

SEQ ID NO: 4969 - protein, 4 aa, Segestria florentina
GSCL

SEQ ID NO: 4970 - protein, 4 aa, Segestria florentina
GSCL

SEQ ID NO: 4971 - protein, 4 aa, Segestria florentina
GSCL

SEQ ID NO: 4972 - protein, 4 aa, Segestria florentina
GSCL

SEQ ID NO: 4973 - protein, 4 aa, Segestria florentina
GSCL

SEQ ID NO: 4974 - protein, 4 aa, Segestria florentina
GSCL

SEQ ID NO: 4975 - protein, 4 aa, Segestria florentina
GSCL

SEQ ID NO: 4976 - protein, 3 aa, Phoneutria nigriventer
YGK

SEQ ID NO: 4977 - protein, 4 aa, Tachypleus tridentatus
WNLR

SEQ ID NO: 4978 - protein, 4 aa, Hadronyche formidabilis
PGTS

SEQ ID NO: 4979 - protein, 4 aa, Hadronyche versuta
PGTS

SEQ ID NO: 4980 - protein, 4 aa, Hadronyche versuta
PGTS

SEQ ID NO: 4981 - protein, 4 aa, Hadronyche versuta
PGTS

SEQ ID NO: 4982 - protein, 4 aa, Agelenopsis aperta
RGRG

SEQ ID NO: 4983 - protein, 4 aa, Agelenopsis aperta
RGRP

SEQ ID NO: 4984 - protein, 10 aa, Missulena bradleyi
NNAEEEQTIN

SEQ ID NO: 4985 - protein, 3 aa, Atrax robustus
SGS

SEQ ID NO: 4986 - protein, 3 aa, Hadronyche infensa
SGS

SEQ ID NO: 4987 - protein, 3 aa, Hadronyche versuta
SQS

SEQ ID NO: 4988 - protein, 3 aa, Hadronyche formidabilis
SQS

SEQ ID NO: 4989 - protein, 3 aa, Hadronyche infensa
SQS

SEQ ID NO: 4990 - protein, 3 aa, Hdronyche versuta
SQS

SEQ ID NO: 4991 - protein, 3 aa, Hadronyche infensa
SGS

SEQ ID NO: 4992 - protein, 3 aa, Hadronyche versuta
SQS

SEQ ID NO: 4993 - protein, 3 aa, Hadronyche versuta
SKS

SEQ ID NO: 4994 - protein, 3 aa, Hadronyche versuta
SQS

SEQ ID NO: 4995 - protein, 3 aa, Hadronyche versuta
SGS

SEQ ID NO: 4996 - protein, 5 aa, Atrax
GLTPI

SEQ ID NO: 4997 - protein, 5 aa, Hadronyche infensa
GMTPS

SEQ ID NO: 4998 - protein, 5 aa, Hadronyche versuta
ELTPV

SEQ ID NO: 4999 - protein, 5 aa, Atrax
GLTPT

SEQ ID NO: 5000 - protein, 5 aa, Hadronyche infensa
GMTPS

SEQ ID NO: 5001 - protein, 8 aa, Cupiennius salei
RSKMFKDV

SEQ ID NO: 5002 - protein, 3 aa, Phoneutria nigriventer
YGK

SEQ ID NO: 5003 - protein, 3 aa, Phoneturia reidyi
NGR

SEQ ID NO: 5004 - protein, 8 aa, Phoneutria keyserlingi
VVNGYSRT

SEQ ID NO: 5005 - protein, 4 aa, Lycosa kazakhstanicus
FPWS

SEQ ID NO: 5006 - protein, 4 aa, Certagyrus marshalli
KNYT

SEQ ID NO: 5007 - protein, 4 aa, Grammostola rosea
EDMV

SEQ ID NO: 5008 - protein, 4 aa, Heteroscodra maculata
KHLS

SEQ ID NO: 5009 - protein, 4 aa, Psalmopoeus cambridgei
KHLS

SEQ ID NO: 5010 - protein, 4 aa, Stromatopelma calceatum griseipes
KHLA

SEQ ID NO: 5011 - protein, 4 aa, Stromatopelma calceatum
PHLG

SEQ ID NO: 5012 - protein, 4 aa, Theraphosa blondi
PNRE

SEQ ID NO: 5013 - protein, 3 aa, Phoneutria keyserlingi
NGR

SEQ ID NO: 5014 - protein, 4 aa, Phoneutria keyserlingi
KLYT

SEQ ID NO: 5015 - protein, 4 aa, Phoneutria nigriventer
RGWK

SEQ ID NO: 5016 - protein, 3 aa, Phoneutria nigriventer
YGK

SEQ ID NO: 5017 - protein, 4 aa, Phoneutria nigriventer
KGLR

SEQ ID NO: 5018 - protein, 4 aa, Phoneutria reidyi
KGLT

SEQ ID NO: 5019 - protein, 4 aa, Phoneutria nigriventer
KKFK

SEQ ID NO: 5020 - protein, 4 aa, Ceratogyrus marshalli
KNYT

SEQ ID NO: 5021 - protein, 4 aa, Heteroscodra maculata
EHLV

SEQ ID NO: 5022 - protein, 4 aa, Psalmopoeus cambridgei
EHLS

SEQ ID NO: 5023 - protein, 4 aa, Theraphosa blondi
PNRV

SEQ ID NO: 5024 - protein, 4 aa, Phoneutria nigriventer
EERP

SEQ ID NO: 5025 - protein, 4 aa, Segestria florentina
PKSR

SEQ ID NO: 5026 - protein, 4 aa, Phoneutria keyserlingi
IGLR

SEQ ID NO: 5027 - protein, 4 aa, Phoneutria nigriventer
EDRP

SEQ ID NO: 5028 - protein, 9 aa, Phoneutria nigriventer
DGYNGYKRA

SEQ ID NO: 5029 - protein, 4 aa, Phoneutria nigriventer
RLYT

SEQ ID NO: 5030 - protein, 4 aa, Phoneutria nigriventer
WPWS

SEQ ID NO: 5031 - protein, 4 aa, Phoneutria reidyi
ENRP

SEQ ID NO: 5032 - protein, 4 aa, Phoneutria nigriventer
KDRA

SEQ ID NO: 5033 - protein, 4 aa, Ceratogyrus marshalli
PHLG

SEQ ID NO: 5034 - protein, 15 aa, Loxosceles intermedia
NDWKYKGRCGCTMGV

SEQ ID NO: 5035 - protein, 5 aa, Paraphysa scrofa
RPNLV

SEQ ID NO: 5036 - protein, 4 aa, Psalmopeoeus cambridgei
EHLQ

SEQ ID NO: 5037 - protein, 4 aa, Theraphosa blondi
PNRV

SEQ ID NO: 5038 - protein, 4 aa, Hysterocrates gigas
PRLG

SEQ ID NO: 5039 - protein, 4 aa, Heteropoda venatoria
PNWV

SEQ ID NO: 5040 - protein, 4 aa, Heteropoda venatoria
ENWA

SEQ ID NO: 5041 - protein, 4 aa, Allagelena opulenta
SGLK

SEQ ID NO: 5042 - protein, 4 aa, Agelena orientalis
SGLK

SEQ ID NO: 5043 - protein, 8 aa, Cupiennius salei
RKGLFKLK

SEQ ID NO: 5044 - protein, 4 aa, Hololena curta
DGYY

SEQ ID NO: 5045 - protein, 4 aa, Hololena curta
SGYY

SEQ ID NO: 5046 - protein, 4 aa, Hololena curta
SGYY

SEQ ID NO: 5047 - protein, 4 aa, Phoneutria nigriventer
TNLK

SEQ ID NO: 5048 - protein, 4 aa, Phoneutria reidyi
NNRT

SEQ ID NO: 5049 - protein, 8 aa, Cupiennius salei
KKGLTKMK

SEQ ID NO: 5050 - protein, 4 aa, Pireneitega luctuosa
DGFY

SEQ ID NO: 5051 - protein, 4 aa, Pireneitega luctuosa
DGYY

SEQ ID NO: 5052 - protein, 4 aa, Pireneitega luctuosa
GEMW

SEQ ID NO: 5053 - protein, 4 aa, Pireneitega luctuosa
DGFY

SEQ ID NO: 5054 - protein, 4 aa, Hadronyche versuta
CPMK

SEQ ID NO: 5055 - protein, 4 aa, Psalmopoeus cambridgei
RGLQ

SEQ ID NO: 5056 - protein, 2 aa, Psalmopoeus cambridgei
GS

SEQ ID NO: 5057 - protein, 4 aa, Ctenus ornatus
EDRV

SEQ ID NO: 5058 - protein, 4 aa, Chilobrachys jingzhao
PKYV

SEQ ID NO: 5059 - protein, 4 aa, Chilobrachys jingzhao
PKYV

SEQ ID NO: 5060 - protein, 4 aa, Chilobrachys jingzhao
AHLG

SEQ ID NO: 5061 - protein, 2 aa, Haplopelma schmidti
GV

SEQ ID NO: 5062 - protein, 4 aa, Haplopelma schmidti
PNRV

SEQ ID NO: 5063 - protein, 4 aa, Haplopelma schmidti
SGYV

SEQ ID NO: 5064 - protein, 6 aa, Haplopelma schmidti
KSSKLV

SEQ ID NO: 5065 - protein, 4 aa, Haplopelma schmidti
KHLQ

SEQ ID NO: 5066 - protein, 4 aa, Haplopelma schmidti
AGLR

SEQ ID NO: 5067 - protein, 4 aa, Haplopelma hainanum
SGYA

SEQ ID NO: 5068 - protein, 4 aa, Haplopelma hainanum
PNYA

SEQ ID NO: 5069 - protein, 6 aa, Haplopelma hainanum
KSSNLV

SEQ ID NO: 5070 - protein, 6 aa, Haplopelma hainanum
KSANLV

SEQ ID NO: 5071 - protein, 4 aa, Grammostola rosea
KHLG

SEQ ID NO: 5072 - protein, 4 aa, Grammostola rosea
KHLG

SEQ ID NO: 5073 - protein, 4 aa, Heteropoda venatoria
EGWK

SEQ ID NO: 5074 - protein, 4 aa, Diguetia canities
EGYV

SEQ ID NO: 5075 - protein, 4 aa, Diguetia canities
EGFI

SEQ ID NO: 5076 - protein, 13 aa, Heteropoda venatoria
DQQYLWYKWRNLA

SEQ ID NO: 5077 - protein, 13 aa, Hapopelma schmidti
QKQYLWYKWRPLD

SEQ ID NO: 5078 - protein, 4 aa, Lasiodora
EGYV

SEQ ID NO: 5079 - protein, 4 aa, Macrothele gigas
SGYV

SEQ ID NO: 5080 - protein, 4 aa, Macrothele gigas
SYAE

SEQ ID NO: 5081 - protein, 4 aa, Ctenus ornatus
PGLS

SEQ ID NO: 5082 - protein, 4 aa, Agelenopsis aperta
GWNI

SEQ ID NO: 5083 - protein, 4 aa, Macrothele gigas
EDRV

SEQ ID NO: 5084 - protein, 4 aa, Agelenopsis aperta
EGFY

SEQ ID NO: 5085 - protein, 4 aa, ;PRT1;Macrothele gigas
FGLE

SEQ ID NO: 5086 - protein, 4 aa, Agelenopsis aperta
DGLY

SEQ ID NO: 5087 - protein, 6 aa, Macrothele gigas
KHRKLE

SEQ ID NO: 5088 - protein, 4 aa, Agelenopsis aperta
SGYY

SEQ ID NO: 5089 - protein, 4 aa, Agelenopsis aperta
DGYY

SEQ ID NO: 5090 - protein, 4 aa, Agelenopsis aperta
DGYY

SEQ ID NO: 5091 - protein, 4 aa, ;PRT1;Macrothele gigas
GWNA

SEQ ID NO: 5092 - protein, 4 aa, Agelenopsis aperta
DGYY

SEQ ID NO: 5093 - protein, 4 aa, ;PRT1;Macrothele gigas
GSQI

SEQ ID NO: 5094 - protein, 4 aa, ;PRT1;Macrothele gigas
KGYS

SEQ ID NO: 5095 - protein, 4 aa, ;PRT1;Macrothele gigas
KGSS

SEQ ID NO: 5096 - protein, 4 aa, ;PRT1;Macrothele gigas
GALR

SEQ ID NO: 5097 - protein, 4 aa, Paraphysa scrofa
EGLV

SEQ ID NO: 5098 - protein, 4 aa, Psalmopoeus cambridgei
EGLE

SEQ ID NO: 5099 - protein, 4 aa, Paraphysa scrofa
EGLV

SEQ ID NO: 5100 - protein, 3 aa, Apomastus schlingeri
GGK

SEQ ID NO: 5101 - protein, 4 aa, Brachypelma smithi
GKLE

SEQ ID NO: 5102 - protein, 4 aa, Apomastus schlingeri
SGLK

SEQ ID NO: 5103 - protein, 4 aa, Thrixopelma pruriens
KHLV

SEQ ID NO: 5104 - protein, 4 aa, Thrixopelma pruriens
EGMV

SEQ ID NO: 5105 - protein, 4 aa, Macrothele gigas
ADLE

SEQ ID NO: 5106 - protein, 4 aa, Macrothele raveni
GWNA

SEQ ID NO: 5107 - protein, 4 aa, Heteropoda venatoria
EGYV

SEQ ID NO: 5108 - protein, 4 aa, Coremiocnemis valida
DGLY

SEQ ID NO: 5109 - protein, 4 aa, Grammostola rosea
KDLV

SEQ ID NO: 5110 - protein, 4 aa, Grammostola rosea
EGLV

SEQ ID NO: 5111 - protein, 4 aa, Grammostola rosea
EGYK

SEQ ID NO: 5112 - protein, 4 aa, Grammostola rosea
PHLA

SEQ ID NO: 5113 - protein, 6 aa, Asteropus simplex
IALELE

SEQ ID NO: 5114 - protein, 4 aa, Terebra sublata
EHHE

SEQ ID NO: 5115 - protein, 16 aa, Hyposoter fugitivus ichnovirus
RQQQLEVGQIIPEDFV

SEQ ID NO: 5116 - protein, 16 aa, Hyposoter fugitivus ichnovirus
RQQELRIGQTIPEDFI

SEQ ID NO: 5117 - protein, 16 aa, Hyposoter fugitivus ichnovirus
QPVVLNGFHVRHYERI

SEQ ID NO: 5118 - protein, 16 aa, Hyposoter fugitivus ichnovirus
QPAVLLNRHIRHYERI

SEQ ID NO: 5119 - protein, 16 aa, Hyposoter fugitivus ichnovirus
QPTVLRHGYDRHRENI

SEQ ID NO: 5120 - protein, 16 aa, Campoletis sonorensis ichnovirus
GQQLMEDGTLGPKHFV

SEQ ID NO: 5121 - protein, 16 aa, Cotesia congregate bracovirus
QESEIGNSSSLVKKIH

SEQ ID NO: 5122 - protein, 17 aa, Cotesia congregate bracovirus
KLTYQNSYLRLGEVPTT

SEQ ID NO: 5123 - protein, 5 aa, Campoletis sonorensis ichnovirus
DQHSI

SEQ ID NO: 5124 - protein, 5 aa, Campoletis sonorensis ichnovirus
DQHSI

SEQ ID NO: 5125 - protein, 14 aa, Campoletis sonorensis ichnovirus
SRYEDGEISPRKFV

SEQ ID NO: 5126 - protein, 14 aa, Campoletis sonorensis ichnovirus
SRYEDGEISPRKFV

SEQ ID NO: 5127 - protein, 17 aa, Campoletis sonorensis ichnovirus
GQEALPTSGVLVGQEYT

SEQ ID NO: 5128 - protein, 16 aa, Campoletis sonorensis ichnovirus
HQQSLERGQVLPHDFI

SEQ ID NO: 5129 - protein, 16 aa, Campoletis sonorensis ichnovirus
HQQSLERGQVLPHDFI

SEQ ID NO: 5130 - protein, 16 aa, Campoletis sonorensis ichnovirus
DHGLSTQGAWMSEEHT

SEQ ID NO: 5131 - protein, 16 aa, Campoletis chlorideae ichnovirus
RLEDRTSVRFGREEYI

SEQ ID NO: 5132 - protein, 16 aa, Campoletis sonorensis ichnovirus
SKTVRYGDSKNVRKFI

SEQ ID NO: 5133 - protein, 17 aa, Campoletis sp. Ichnovirus
  misc_feature (11)..(11): Xaa can be any naturally occurring amino acid
GEEAVPQLGIXFGVEFT

SEQ ID NO: 5134 - protein, 16 aa, Campoletis sonorensis ichnovirus
RLEDRTSVQFGRKEYI

SEQ ID NO: 5135 - protein, 3 aa, Ectoropis oblique NPV
SNA

SEQ ID NO: 5136 - protein, 3 aa, Antheraea pernyi nuclear polyhedrosis virus
SGA

SEQ ID NO: 5137 - protein, 3 aa, Helicoverpa armigera granulovirus
SGA

SEQ ID NO: 5138 - protein, 3 aa, Orgyia leucostigma NPV
SGA

SEQ ID NO: 5139 - protein, 3 aa, Orgyia pseudotsugata multicapsid polyhedrosis virus
SGA

SEQ ID NO: 5140 - protein, 3 aa, Autographa californica nuclear polyhedrosis virus
SGA

SEQ ID NO: 5141 - protein, 3 aa, Anticarsia gemmatalis nuclear polyhedrosis virus
SGA

SEQ ID NO: 5142 - protein, 3 aa, Plutella xylostella multiple nucleopolyhedrovirus
SGA

SEQ ID NO: 5143 - protein, 3 aa, Antheraea pernyi nuclear polyhedrosis virus
SGA

SEQ ID NO: 5144 - protein, 3 aa, Mamestra configurata NPV-B
SGA

SEQ ID NO: 5145 - protein, 3 aa, Mamestra configurata NPV-A
SGA

SEQ ID NO: 5146 - protein, 3 aa, Xestia c-nigrum granulosis virus
SGA

SEQ ID NO: 5147 - protein, 1 aa, Hybanthus parviflorus
S

SEQ ID NO: 5148 - protein, 1 aa, Chassalia parvifolia
S

SEQ ID NO: 5149 - protein, 1 aa, Viola baoshanensis
S

SEQ ID NO: 5150 - protein, 1 aa, Viola baoshanensis
S

SEQ ID NO: 5151 - protein, 1 aa, Viola baoshanensis
S

SEQ ID NO: 5152 - protein, 1 aa, Viola baoshanensis
S

SEQ ID NO: 5153 - protein, 1 aa, Viola baoshanensis
S

SEQ ID NO: 5154 - protein, 1 aa, Viola baoshanensis
K

SEQ ID NO: 5155 - protein, 1 aa, Viola baoshanensis
K

SEQ ID NO: 5156 - protein, 1 aa, Viola baoshanensis
S

SEQ ID NO: 5157 - protein, 1 aa, Oldenlandia affinis
K

SEQ ID NO: 5158 - protein, 1 aa, Oldenlandia affinis
K

SEQ ID NO: 5159 - protein, 1 aa, Melicytus ramiflorus
K

SEQ ID NO: 5160 - protein, 1 aa, Viola hederacea
S

SEQ ID NO: 5161 - protein, 1 aa, Viola biflora
G

SEQ ID NO: 5162 - protein, 1 aa, Viola odorata
S

SEQ ID NO: 5163 - protein, 1 aa, Hybanthus floribundus E
T

SEQ ID NO: 5164 - protein, 1 aa, Hybanthus floribundus E
K

SEQ ID NO: 5165 - protein, 1 aa, Hybanthus floribundus E
S

SEQ ID NO: 5166 - protein, 1 aa, Hybanthus floribundus E
S

SEQ ID NO: 5167 - protein, 1 aa, Hybanthus floribundus E
T

SEQ ID NO: 5168 - protein, 1 aa, Hybanthus floribundus E
T

SEQ ID NO: 5169 - protein, 1 aa, Chassalia parvifolia
S

SEQ ID NO: 5170 - protein, 1 aa, Chassalia parvifolia
S

SEQ ID NO: 5171 - protein, 1 aa, Chassalia parvifolia
K

SEQ ID NO: 5172 - protein, 1 aa, Chassalia parvifolia
K

SEQ ID NO: 5173 - protein, 1 aa, Psychotria longipes
S

SEQ ID NO: 5174 - protein, 1 aa, Viola baoshanensis
S

SEQ ID NO: 5175 - protein, 1 aa, Viola baoshanensis
S

SEQ ID NO: 5176 - protein, 1 aa, Viola baoshanensis
S

SEQ ID NO: 5177 - protein, 1 aa, Viola baoshanensis
S

SEQ ID NO: 5178 - protein, 1 aa, Viola baoshanensis
S

SEQ ID NO: 5179 - protein, 1 aa, Viola baoshanensis
S

SEQ ID NO: 5180 - protein, 1 aa, Viola baoshanensis
S

SEQ ID NO: 5181 - protein, 1 aa, Viola baoshanensis
I

SEQ ID NO: 5182 - protein, 1 aa, Viola baoshanensis
S

SEQ ID NO: 5183 - protein, 1 aa, Viola baoshanensis
S

SEQ ID NO: 5184 - protein, 1 aa, Viola baoshanensis
S

SEQ ID NO: 5185 - protein, 1 aa, Viola baoshanensis
S

SEQ ID NO: 5186 - protein, 1 aa, Viola baoshanensis
S

SEQ ID NO: 5187 - protein, 1 aa, Viola baoshanensis
S

SEQ ID NO: 5188 - protein, 1 aa, Viola baoshanensis
S

SEQ ID NO: 5189 - protein, 1 aa, Viola baoshanensis
S

SEQ ID NO: 5190 - protein, 1 aa, Viola baoshanensis
S

SEQ ID NO: 5191 - protein, 1 aa, Viola baoshanensis
S

SEQ ID NO: 5192 - protein, 1 aa, Viola baoshanensis
S

SEQ ID NO: 5193 - protein, 1 aa, Viola baoshanensis
S

SEQ ID NO: 5194 - protein, 1 aa, Viola baoshanensis
S

SEQ ID NO: 5195 - protein, 1 aa, Viola baoshanensis
S

SEQ ID NO: 5196 - protein, 1 aa, Leonia cymosa
T

SEQ ID NO: 5197 - protein, 1 aa, Leonia cymosa
S

SEQ ID NO: 5198 - protein, 1 aa, Leonia cymosa
S

SEQ ID NO: 5199 - protein, 1 aa, Hedyotis centranthoides
S

SEQ ID NO: 5200 - protein, 1 aa, Hedyotis terminalis
S

SEQ ID NO: 5201 - protein, 1 aa, Oldenlandia affinis
S

SEQ ID NO: 5202 - protein, 1 aa, Oldenlandia affinis
S

SEQ ID NO: 5203 - protein, 1 aa, Oldenlandia affinis
S

SEQ ID NO: 5204 - protein, 1 aa, Melicytus ramiflorus
S

SEQ ID NO: 5205 - protein, 1 aa, Melicytus ramiflorus
S

SEQ ID NO: 5206 - protein, 1 aa, Melicytus ramiflorus
S

SEQ ID NO: 5207 - protein, 1 aa, Viola hederacea
S

SEQ ID NO: 5208 - protein, 1 aa, Viola biflora
S

SEQ ID NO: 5209 - protein, 1 aa, Viola biflora
P

SEQ ID NO: 5210 - protein, 1 aa, Viola tricolor
S

SEQ ID NO: 5211 - protein, 1 aa, Hybathus floribundus E
S

SEQ ID NO: 5212 - protein, 1 aa, Hybathus floribundus E
Y

SEQ ID NO: 5213 - protein, 1 aa, Hybathus floribundus E
S

SEQ ID NO: 5214 - protein, 1 aa, Psychotria suterella
S

SEQ ID NO: 5215 - protein, 1 aa, Chassalia parvifolia
S

SEQ ID NO: 5216 - protein, 1 aa, Viola baoshanensis
S

SEQ ID NO: 5217 - protein, 1 aa, Viola baoshanensis
T

SEQ ID NO: 5218 - protein, 1 aa, Viola baoshanensis
G

SEQ ID NO: 5219 - protein, 1 aa, Viola baoshanensis
A

SEQ ID NO: 5220 - protein, 1 aa, Viola hederacea
S

SEQ ID NO: 5221 - protein, 1 aa, Viola hederacea
I

SEQ ID NO: 5222 - protein, 1 aa, Viola odorata
S

SEQ ID NO: 5223 - protein, 1 aa, Viola odorata
S

SEQ ID NO: 5224 - protein, 1 aa, Viola odorata
S

SEQ ID NO: 5225 - protein, 1 aa, Viola odorata
S

SEQ ID NO: 5226 - protein, 1 aa, Viola odorata
S

SEQ ID NO: 5227 - protein, 1 aa, Viola odorata
T

SEQ ID NO: 5228 - protein, 1 aa, Viola odorata
T

SEQ ID NO: 5229 - protein, 1 aa, Viola odorata
T

SEQ ID NO: 5230 - protein, 1 aa, Viola odorata
T

SEQ ID NO: 5231 - protein, 1 aa, Viola odorata
S

SEQ ID NO: 5232 - protein, 1 aa, Viola odorata
S

SEQ ID NO: 5233 - protein, 1 aa, Leonia cymosa
S

SEQ ID NO: 5234 - protein, 1 aa, Oldenlandia affinis
T

SEQ ID NO: 5235 - protein, 1 aa, Oldenlandia affinis
S

SEQ ID NO: 5236 - protein, 1 aa, Oldenlandia affinis
S

SEQ ID NO: 5237 - protein, 1 aa, Oldenlandia affinis
S

SEQ ID NO: 5238 - protein, 1 aa, Oldenlandia affinis
A

SEQ ID NO: 5239 - protein, 1 aa, Oldenlandia affinis
A

SEQ ID NO: 5240 - protein, 1 aa, Oldenlandia affinis
S

SEQ ID NO: 5241 - protein, 1 aa, Oldenlandia affinis
S

SEQ ID NO: 5242 - protein, 1 aa, Oldenlandia affinis
T

SEQ ID NO: 5243 - protein, 1 aa, Oldenlandia affinis
T

SEQ ID NO: 5244 - protein, 1 aa, Oldenlandia affinis
S

SEQ ID NO: 5245 - protein, 1 aa, Oldenlandia affinis
T

SEQ ID NO: 5246 - protein, 1 aa, Oldenlandia affinis
S

SEQ ID NO: 5247 - protein, 1 aa, Melicytus ramiflorus
S

SEQ ID NO: 5248 - protein, 1 aa, Melicytus ramiflorus
S

SEQ ID NO: 5249 - protein, 1 aa, Melicytus ramiflorus
T

SEQ ID NO: 5250 - protein, 1 aa, Melicytus ramiflorus
T

SEQ ID NO: 5251 - protein, 1 aa, Melicytus ramiflorus
S

SEQ ID NO: 5252 - protein, 1 aa, Melicytus ramiflorus
S

SEQ ID NO: 5253 - protein, 1 aa, Melicytus ramiflorus
S

SEQ ID NO: 5254 - protein, 1 aa, Melicytus ramiflorus
S

SEQ ID NO: 5255 - protein, 1 aa, Melicytus ramiflorus
S

SEQ ID NO: 5256 - protein, 1 aa, Viola odorata
S

SEQ ID NO: 5257 - protein, 1 aa, Viola odorata
S

SEQ ID NO: 5258 - protein, 1 aa, Viola odorata
S

SEQ ID NO: 5259 - protein, 1 aa, Viola odorata
S

SEQ ID NO: 5260 - protein, 1 aa, Viola odorata
S

SEQ ID NO: 5261 - protein, 1 aa, Viola odorata
S

SEQ ID NO: 5262 - protein, 1 aa, Viola odorata
S

SEQ ID NO: 5263 - protein, 1 aa, Viola odorata
S

SEQ ID NO: 5264 - protein, 1 aa, Viola hederacea
T

SEQ ID NO: 5265 - protein, 1 aa, Viola biflora
S

SEQ ID NO: 5266 - protein, 1 aa, Viola biflora
T

SEQ ID NO: 5267 - protein, 1 aa, Viola biflora
S

SEQ ID NO: 5268 - protein, 1 aa, Viola biflora
T

SEQ ID NO: 5269 - protein, 1 aa, Viola biflora
S

SEQ ID NO: 5270 - protein, 1 aa, Viola biflora
S

SEQ ID NO: 5271 - protein, 1 aa, Viola biflora
S

SEQ ID NO: 5272 - protein, 1 aa, Viola biflora
A

SEQ ID NO: 5273 - protein, 1 aa, Viola cotyledon
S

SEQ ID NO: 5274 - protein, 1 aa, Viola cotyledon
S

SEQ ID NO: 5275 - protein, 1 aa, Viola arvensis
S

SEQ ID NO: 5276 - protein, 1 aa, Viola odorata
S

SEQ ID NO: 5277 - protein, 1 aa, Viola odorata
S

SEQ ID NO: 5278 - protein, 1 aa, Chassalia discolor
S

SEQ ID NO: 5279 - protein, 1 aa, Hybanthus floribundus E
T

SEQ ID NO: 5280 - protein, 1 aa, Hybanthus floribundus E
T

SEQ ID NO: 5281 - protein, 1 aa, Viola odorata
S

SEQ ID NO: 5282 - protein, 1 aa, Oldenlandia affinis
T

SEQ ID NO: 5283 - protein, 1 aa, Oldenlandia affinis
T

SEQ ID NO: 5284 - protein, 1 aa, Oldenlandia affinis
T

SEQ ID NO: 5285 - protein, 1 aa, Melcytus ramiflorus
T

SEQ ID NO: 5286 - protein, 1 aa, Palicourea condensata
T

SEQ ID NO: 5287 - protein, 1 aa, Viola yedoensis
S

SEQ ID NO: 5288 - protein, 1 aa, Viola yedoensis
S

SEQ ID NO: 5289 - protein, 1 aa, Viola yedoensis
S

SEQ ID NO: 5290 - protein, 1 aa, Viola arvensis
S

SEQ ID NO: 5291 - protein, 1 aa, Viola arvensis
S

SEQ ID NO: 5292 - protein, 11 aa, Tachypleus tridentatus
RSYFPGSTYGR

SEQ ID NO: 5293 - protein, 11 aa, Tachypleus tridentatus
RSYFPGSTYGR

SEQ ID NO: 5294 - protein, 11 aa, Tachypleus tridentatus
RRDFPGSIFGT

SEQ ID NO: 5295 - protein, 11 aa, Tachypleus tridentatus
RRDFPGSIFGT

SEQ ID NO: 5296 - protein, 10 aa, Takifugu rubripes
QCRLFRTVCY

SEQ ID NO: 5297 - protein, 10 aa, Takifugu rubripes
HCRFFNAICF

SEQ ID NO: 5298 - protein, 10 aa, Takifugu rubripes
YCRFFNAICY

SEQ ID NO: 5299 - protein, 10 aa, Takifugu rubripes
HCRLFNTICN

SEQ ID NO: 5300 - protein, 10 aa, Aotus sp. Aot1
QCRFFRSACS

SEQ ID NO: 5301 - protein, 10 aa, Mus musculus
QCRFFGSACT

SEQ ID NO: 5302 - protein, 10 aa, Canis lupus
QCRFFRSACT

SEQ ID NO: 5303 - protein, 10 aa, Tetrao urogallus
YCRFFNAFCY

SEQ ID NO: 5304 - protein, 10 aa, Tragopan temminckii
YCRFFNAFCY

SEQ ID NO: 5305 - protein, 10 aa, Tragopan satyra
YCRFFNAFCY

SEQ ID NO: 5306 - protein, 10 aa, Syrmaticus reevesii
YCRFFNAFCY

SEQ ID NO: 5307 - protein, 10 aa, Rollulus roulroul
YCRFFNAFCY

SEQ ID NO: 5308 - protein, 10 aa, Perdix perdix
YCRFFNAFCY

SEQ ID NO: 5309 - protein, 10 aa, Polyplectron malacense
YCRFFNAFCY

SEQ ID NO: 5310 - protein, 10 aa, Pavo muticus
YCRFFNAFCY

SEQ ID NO: 5311 - protein, 10 aa, Polyplectron inopinatum
YCRFFNAFCY

SEQ ID NO: 5312 - protein, 10 aa, Polyplectron napolenois
YCRFFNAFCY

SEQ ID NO: 5313 - protein, 10 aa, Phasianus colchincus
YCRFFNAFCY

SEQ ID NO: 5314 - protein, 10 aa, Pavo cristatus
YCRFFNAFCY

SEQ ID NO: 5315 - protein, 10 aa, Melegaris gallopavo
YCRFFNAFCY

SEQ ID NO: 5316 - protein, 10 aa, Tetrao tetrix
YCRFFNAFCY

SEQ ID NO: 5317 - protein, 10 aa, Lophura nycthemera
YCRFFNAFCY

SEQ ID NO: 5318 - protein, 10 aa, Lagopus lagopus scotica
YCRFFNAFCY

SEQ ID NO: 5319 - protein, 10 aa, Lophophorus impejanus
YCRFFNAFCY

SEQ ID NO: 5320 - protein, 10 aa, Lophura edwardsi
YCRFFNAFCY

SEQ ID NO: 5321 - protein, 10 aa, Lophura diardi
YCRFFNAFCY

SEQ ID NO: 5322 - protein, 10 aa, Gallus sonneratii
YCRFFNAFCY

SEQ ID NO: 5323 - protein, 10 aa, Francolinus pondicerianus
YCRFFNAFCY

SEQ ID NO: 5324 - protein, 10 aa, Francolinus levaillantii
YCRFFNAFCY

SEQ ID NO: 5325 - protein, 10 aa, Catreus wallichii
YCRFFNAFCY

SEQ ID NO: 5326 - protein, 10 aa, Crossoptilon mantchuricum
YCRFFNAFCY

SEQ ID NO: 5327 - protein, 10 aa, Coturnix coturnix japonica
YCRFFNAFCY

SEQ ID NO: 5328 - protein, 10 aa, Coturnix coturnix
YCRFFNAFCY

SEQ ID NO: 5329 - protein, 10 aa, Crossoptilon crossoptilon
YCRFFNAFCY

SEQ ID NO: 5330 - protein, 10 aa, Alectoris chukar
YCRFFNAFCY

SEQ ID NO: 5331 - protein, 10 aa, Afropavo congensis
YCRFFNAFCY

SEQ ID NO: 5332 - protein, 10 aa, Argusianus argus
YCRFFNAFCY

SEQ ID NO: 5333 - protein, 10 aa, Alectoris rufa
YCRFFNAFCY

SEQ ID NO: 5334 - protein, 10 aa, Peromyscus maniculatus
QCRFFRSVCS

SEQ ID NO: 5335 - protein, 10 aa, Peromyscus polionotus subgriseus
QCRFFRSVCS

SEQ ID NO: 5336 - protein, 10 aa, Peromyscus polionotus leucocephalus
QCRFFRSVCS

SEQ ID NO: 5337 - protein, 10 aa, Coturnix coturnix japonica
KCRIFQTICQ

SEQ ID NO: 5338 - protein, 10 aa, Coturnix coturnix japonica
KCRIFQTICQ

SEQ ID NO: 5339 - protein, 10 aa, Capra hircus
QCRFFRSACS

SEQ ID NO: 5340 - protein, 10 aa, Bos taurus
YCRFFNAFCY

SEQ ID NO: 5341 - protein, 10 aa, Homo sapiens
YCRFFNAFCY

SEQ ID NO: 5342 - protein, 10 aa, Mus musculus
YCRFFNAFCY

SEQ ID NO: 5343 - protein, 10 aa, Sus scrofa
YCRFFNAFCY

SEQ ID NO: 5344 - protein, 10 aa, Bos taurus
QCRFFRSACS

SEQ ID NO: 5345 - protein, 10 aa, Callithrix geoffroyi
QCRFFRSACS

SEQ ID NO: 5346 - protein, 10 aa, Callimico goeldii
QCRFFRSACS

SEQ ID NO: 5347 - protein, 10 aa, Callithrix jacchus
QCRFFRSACS

SEQ ID NO: 5348 - protein, 10 aa, Canis familiaris
QCRFFRSACT

SEQ ID NO: 5349 - protein, 10 aa, Cebuella pygmaea
QCRFFRSACS

SEQ ID NO: 5350 - protein, 10 aa, Chlorocebus aethiops
QCRFFRSACS

SEQ ID NO: 5351 - protein, 10 aa, Cercopithecus mitis
QCRFFRSACS

SEQ ID NO: 5352 - protein, 10 aa, Colobus polykomos
QCRFFRSACS

SEQ ID NO: 5353 - protein, 10 aa, Erythrocebus patas
QCRFFRSACS

SEQ ID NO: 5354 - protein, 10 aa, Felis catus
QCRFFRSSCS

SEQ ID NO: 5355 - protein, 10 aa, Gorilla gorilla gorilla
QCRFFRSACS

SEQ ID NO: 5356 - protein, 10 aa, Equus caballus
QCRFFRSACS

SEQ ID NO: 5357 - protein, 10 aa, Homo sapiens
QCRFFRSACS

SEQ ID NO: 5358 - protein, 10 aa, Leontopithecus chrysomelas
QCRFFRSACS

SEQ ID NO: 5359 - protein, 10 aa, Leontopithecus rosalia
QCRFFRSACS

SEQ ID NO: 5360 - protein, 10 aa, Macaca arctoides
QCRFFRSACS

SEQ ID NO: 5361 - protein, 10 aa, Macaca assamensis
QCRFFRSACS

SEQ ID NO: 5362 - protein, 10 aa, Macaca cyclopis
QCRFFRSACS

SEQ ID NO: 5363 - protein, 10 aa, Macaca fascicularis
QCRFFRSACS

SEQ ID NO: 5364 - protein, 10 aa, Macaca fuscata fuscata
QCRFFRSACS

SEQ ID NO: 5365 - protein, 10 aa, Macaca hecki
QCRFFRSACS

SEQ ID NO: 5366 - protein, 10 aa, Macaca maura
QCRFFRSACS

SEQ ID NO: 5367 - protein, 10 aa, Macaca mulatta
QCRFFRSACS

SEQ ID NO: 5368 - protein, 10 aa, Macaca nemestrina
QCRFFRSACS

SEQ ID NO: 5369 - protein, 10 aa, Macaca nigra
QCRFFRSACS

SEQ ID NO: 5370 - protein, 10 aa, Macaca nigrescens
QCRFFRSACS

SEQ ID NO: 5371 - protein, 10 aa, Macaca radiata
QCRFFRSACS

SEQ ID NO: 5372 - protein, 10 aa, Macaca sinica
QCRFFRSACS

SEQ ID NO: 5373 - protein, 10 aa, Macaca silenus
QCRFFRSACS

SEQ ID NO: 5374 - protein, 10 aa, Macaca sylvanus
QCRFFRSACS

SEQ ID NO: 5375 - protein, 10 aa, Mus musculus
QCRFFGSACT

SEQ ID NO: 5376 - protein, 10 aa, Pan paniscus
QCRFFRSACS

SEQ ID NO: 5377 - protein, 10 aa, Pan troglodytes
QCRFFRSACS

SEQ ID NO: 5378 - protein, 10 aa, Papio anubis
QCRFFRSACS

SEQ ID NO: 5379 - protein, 10 aa, Sus scrofa
QCRFFRSACS

SEQ ID NO: 5380 - protein, 10 aa, Pongo pygmaeus
QCRFFRSACS

SEQ ID NO: 5381 - protein, 10 aa, Rattus norvegicus
QCRFFGSACT

SEQ ID NO: 5382 - protein, 10 aa, Semnopithecus entellus
QCRFFRSACS

SEQ ID NO: 5383 - protein, 10 aa, Trachypithecus auratus
QCRFFRSACS

SEQ ID NO: 5384 - protein, 10 aa, Trachypithecus cristatus
QCRFFRSACS

SEQ ID NO: 5385 - protein, 10 aa, Trachypithecus francoisi
QCRFFRSACS

SEQ ID NO: 5386 - protein, 10 aa, Trachypithecus obscurus
QCRFFRSACS

SEQ ID NO: 5387 - protein, 10 aa, Vulpes vulpes
QCRFFRSACT

SEQ ID NO: 5388 - protein, 10 aa, Oryctolagus cuniculus
QCRFFRSVCT

SEQ ID NO: 5389 - protein, 10 aa, Coturnix coturnix japonica
KCRIFQTICQ

SEQ ID NO: 5390 - protein, 10 aa, Gallus gallus
KCRIFQTICQ

SEQ ID NO: 5391 - protein, 10 aa, Gallus gallus
KCRIFQTICQ

SEQ ID NO: 5392 - protein, 10 aa, Gallus gallus
KCRIFQTICQ

SEQ ID NO: 5393 - protein, 10 aa, Mus musculus
YCRFFNAFCY

SEQ ID NO: 5394 - protein, 10 aa, Capra hircus
QCRFFRSACS

SEQ ID NO: 5395 - protein, 10 aa, Tetraodon nigroviridis
YCRFFNAICY

SEQ ID NO: 5396 - protein, 10 aa, Tetraodon nigroviridis
HCRLFNTICN

SEQ ID NO: 5397 - protein, 10 aa, Carassius auratus
HCRLFKTVCY

SEQ ID NO: 5398 - protein, 10 aa, Carassius auratus
HCRLFKTVCY

SEQ ID NO: 5399 - protein, 10 aa, Carassius auratus
HCRLFKTVCY

SEQ ID NO: 5400 - protein, 10 aa, Canis familiaris
QCRFFRSACT

SEQ ID NO: 5401 - protein, 10 aa, Canis lupus
QCRFFRSACT

SEQ ID NO: 5402 - protein, 10 aa, Canis latrans
QCRFFRSACT

SEQ ID NO: 5403 - protein, 10 aa, Ovis aries
YCRFFNAFCY

SEQ ID NO: 5404 - protein, 10 aa, Carassius auratus
YCRFFKAFCY

SEQ ID NO: 5405 - protein, 10 aa, Carassius auratus
YCRFFKAFCY

SEQ ID NO: 5406 - protein, 10 aa, Coturnix coturnix japonica
YCRFFNAFCY

SEQ ID NO: 5407 - protein, 10 aa, Sus scrofa
YCRFFNAFCY

SEQ ID NO: 5408 - protein, 10 aa, Gallus gallus
YCRFFNAFCY

SEQ ID NO: 5409 - protein, 9 aa, Rattus norvegicus
YCRFFKTCY

SEQ ID NO: 5410 - protein, 10 aa, Gallus gallus
YCRFFNAFCY

SEQ ID NO: 5411 - protein, 7 aa, Amaranthus hypochondriacus
TSDYYGN

SEQ ID NO: 5412 - protein, 6 aa, Agriosphodrus dohrni
MFYANR

SEQ ID NO: 5413 - protein, 6 aa, Isyndus obscurs
MFYANR

SEQ ID NO: 5414 - protein, 6 aa, Peirates turpis
SSYANK

SEQ ID NO: 5415 - protein, 3 aa, Conus vexillum
VLV

SEQ ID NO: 5416 - protein, 6 aa, Conus abbreviates
STLSDV

SEQ ID NO: 5417 - protein, 6 aa, Conus abbreviates
DILAST

SEQ ID NO: 5418 - protein, 6 aa, Conus abbreviates
NILAST

SEQ ID NO: 5419 - protein, 6 aa, Conus abbreviates
NPSSKR

SEQ ID NO: 5420 - protein, 4 aa, Conus abbreviates
WRPR

SEQ ID NO: 5421 - protein, 6 aa, Conus abbreviates
NFPRKH

SEQ ID NO: 5422 - protein, 6 aa, Conus abbreviates
NFPRKH

SEQ ID NO: 5423 - protein, 6 aa, Conus abbreviates
NLNTKK

SEQ ID NO: 5424 - protein, 6 aa, Conus abbreviates
NLNTKK

SEQ ID NO: 5425 - protein, 6 aa, Conus abbreviates
NLATKK

SEQ ID NO: 5426 - protein, 6 aa, Conus abbreviates
NLATKK

SEQ ID NO: 5427 - protein, 6 aa, Conus abbreviates
NLATKE

SEQ ID NO: 5428 - protein, 6 aa, Conus abbreviates
NLATKK

SEQ ID NO: 5429 - protein, 6 aa, Conus abbreviates
NLATNK

SEQ ID NO: 5430 - protein, 4 aa, Conus abbreviates
TNNI

SEQ ID NO: 5431 - protein, 4 aa, Conus abbreviates
TNNI

SEQ ID NO: 5432 - protein, 4 aa, Conus abbreviates
TNNI

SEQ ID NO: 5433 - protein, 3 aa, Conus aurisiacus
IVW

SEQ ID NO: 5434 - protein, 4 aa, Conus ammiralis
IVLV

SEQ ID NO: 5435 - protein, 4 aa, Conus ammiralis
IIFF

SEQ ID NO: 5436 - protein, 3 aa, Conus ammiralis
IFL

SEQ ID NO: 5437 - protein, 3 aa, Conus amadis
AFI

SEQ ID NO: 5438 - protein, 3 aa, Conus arenatus
VLV

SEQ ID NO: 5439 - protein, 7 aa, Conus arenatus
KDLQVPT

SEQ ID NO: 5440 - protein, 8 aa, Conus arenatus
VGSRPGGL

SEQ ID NO: 5441 - protein, 6 aa, Conus arenatus
MGEASI

SEQ ID NO: 5442 - protein, 8 aa, Conus arenatus
FGFEDMGL

SEQ ID NO: 5443 - protein, 6 aa, Conus arenatus
IKSIGR

SEQ ID NO: 5444 - protein, 6 aa, Conus arenatus
IKSIGR

SEQ ID NO: 5445 - protein, 6 aa, Conus arenatus
IKSIGR

SEQ ID NO: 5446 - protein, 6 aa, Conus arenatus
NKNIGQ

SEQ ID NO: 5447 - protein, 6 aa, Conus arenatus
NKDSGV

SEQ ID NO: 5448 - protein, 8 aa, Conus arenatus
IDEGGSGV

SEQ ID NO: 5449 - protein, 3 aa, Conus arenatus
IFV

SEQ ID NO: 5450 - protein, 3 aa, Conus arenatus
ARF

SEQ ID NO: 5451 - protein, 3 aa, Conus arenatus
ATT

SEQ ID NO: 5452 - protein, 3 aa, Conus arenatus
AEF

SEQ ID NO: 5453 - protein, 3 aa, Conus arenatus
ARF

SEQ ID NO: 5454 - protein, 3 aa, Conus arenatus
LRY

SEQ ID NO: 5455 - protein, 3 aa, Conus arenatus
APQ

SEQ ID NO: 5456 - protein, 3 aa, Conus arenatus
APQ

SEQ ID NO: 5457 - protein, 3 aa, Conus arenatus
SRI

SEQ ID NO: 5458 - protein, 3 aa, Conus arenatus
GFI

SEQ ID NO: 5459 - protein, 4 aa, Conus arenatus
ILFL

SEQ ID NO: 5460 - protein, 4 aa, Conus arenatus
ILFL

SEQ ID NO: 5461 - protein, 4 aa, Conus arenatus
  misc_feature (1)..(1): Xaa can be any naturally occurring amino acid
XLFL

SEQ ID NO: 5462 - protein, 4 aa, Conus arenatus
VLLA

SEQ ID NO: 5463 - protein, 4 aa, Conus arenatus
VLFL

SEQ ID NO: 5464 - protein, 7 aa, Conus arenatus
EDLQVPT

SEQ ID NO: 5465 - protein, 10 aa, Conus austini
KPGGPLFDFD

SEQ ID NO: 5466 - protein, 5 aa, Conus Aristophanes
SMSNV

SEQ ID NO: 5467 - protein, 6 aa, Conus Aristophanes
NLTRKR

SEQ ID NO: 5468 - protein, 6 aa, Conus Aristophanes
NLPTRK

SEQ ID NO: 5469 - protein, 6 aa, Conus Aristophanes
ISISTT

SEQ ID NO: 5470 - protein, 6 aa, Conus Aristophanes
NTAANS

SEQ ID NO: 5471 - protein, 6 aa, Conus Aristophanes
QRYINS

SEQ ID NO: 5472 - protein, 6 aa, Conus Aristophanes
DRGRNR

SEQ ID NO: 5473 - protein, 6 aa, Conus Aristophanes
NKTTNV

SEQ ID NO: 5474 - protein, 3 aa, Conus aulicus
LLI

SEQ ID NO: 5475 - protein, 4 aa, Conus aulicus
VLLV

SEQ ID NO: 5476 - protein, 3 aa, Conus aulicus
FFA

SEQ ID NO: 5477 - protein, 3 aa, Conus bullatus
FFA

SEQ ID NO: 5478 - protein, 6 aa, Conus betulinus
NKQESV

SEQ ID NO: 5479 - protein, 4 aa, Conus betulinus
TRYY

SEQ ID NO: 5480 - protein, 3 aa, Conus radiates
VEA

SEQ ID NO: 5481 - protein, 3 aa, Conus catus
LGW

SEQ ID NO: 5482 - protein, 4 aa, Conus catus
RSGR

SEQ ID NO: 5483 - protein, 4 aa, Conus catus
RSGR

SEQ ID NO: 5484 - protein, 4 aa, Conus catus
RSGR

SEQ ID NO: 5485 - protein, 4 aa, Conus catus
RSGR

SEQ ID NO: 5486 - protein, 4 aa, Conus catus
RSGR

SEQ ID NO: 5487 - protein, 4 aa, Conus catus
DRGR

SEQ ID NO: 5488 - protein, 4 aa, Conus catus
RSGR

SEQ ID NO: 5489 - protein, 4 aa, Conus catus
RSGR

SEQ ID NO: 5490 - protein, 4 aa, Conus catus
RSGR

SEQ ID NO: 5491 - protein, 5 aa, Conus catus
SRRGK

SEQ ID NO: 5492 - protein, 6 aa, Conus catus
SGTVGR

SEQ ID NO: 5493 - protein, 3 aa, Conus catus
LVW

SEQ ID NO: 5494 - protein, 3 aa, Conus caracteristicus
LLV

SEQ ID NO: 5495 - protein, 3 aa, Conus caracteristicus
ARL

SEQ ID NO: 5496 - protein, 8 aa, Conus capitaneus
SGQSQGGV

SEQ ID NO: 5497 - protein, 3 aa, Conus consors
FLW

SEQ ID NO: 5498 - protein, 4 aa, Conus consors
LFFV

SEQ ID NO: 5499 - protein, 6 aa, Conus consors
SSSKGR

SEQ ID NO: 5500 - protein, 6 aa, Conus coronatus
STMSDV

SEQ ID NO: 5501 - protein, 6 aa, Conus coronatus
NPSTKR

SEQ ID NO: 5502 - protein, 6 aa, Conus coronatus
NLTTKR

SEQ ID NO: 5503 - protein, 6 aa, Conus coronatus
YTPSFT

SEQ ID NO: 5504 - protein, 6 aa, Conus coronatus
NLVTNK

SEQ ID NO: 5505 - protein, 6 aa, Conus coronatus
ITTSST

SEQ ID NO: 5506 - protein, 5 aa, Conus coronatus
NIVHT

SEQ ID NO: 5507 - protein, 8 aa, Conus virgo
TPEGLFEF

SEQ ID NO: 5508 - protein, 9 aa, Conus virgo
RGGGTGGGA

SEQ ID NO: 5509 - protein, 9 aa, Conus virgo
RGGGTGGGV

SEQ ID NO: 5510 - protein, 4 aa, Conus virgo
SRGK

SEQ ID NO: 5511 - protein, 9 aa, Conus virgo
RGGGTGGGV

SEQ ID NO: 5512 - protein, 3 aa, Conus virgo
LFV

SEQ ID NO: 5513 - protein, 6 aa, Conus virgo
DPAKKT

SEQ ID NO: 5514 - protein, 3 aa, Conus virgo
FFV

SEQ ID NO: 5515 - protein, 3 aa, Conus virgo
FFV

SEQ ID NO: 5516 - protein, 9 aa, Conus virgo
RGGGTGGGS

SEQ ID NO: 5517 - protein, 3 aa, Conus virgo
FLW

SEQ ID NO: 5518 - protein, 3 aa, Conus ventricosus
VFA

SEQ ID NO: 5519 - protein, 4 aa, Conus dalli
LLRP

SEQ ID NO: 5520 - protein, 4 aa, Conus dalli
VLVS

SEQ ID NO: 5521 - protein, 4 aa, Conus dalli
ILLF

SEQ ID NO: 5522 - protein, 4 aa, Conus dalli
MVFF

SEQ ID NO: 5523 - protein, 3 aa, Conus dalli
IFV

SEQ ID NO: 5524 - protein, 4 aa, Conus dalli
PSFF

SEQ ID NO: 5525 - protein, 4 aa, Conus dalli
GPFV

SEQ ID NO: 5526 - protein, 4 aa, Conus delessertii
ILLL

SEQ ID NO: 5527 - protein, 4 aa, Conus delessertii
LIYR

SEQ ID NO: 5528 - protein, 4 aa, Conus distans
VGAV

SEQ ID NO: 5529 - protein, 4 aa, Conus distans
LFFV

SEQ ID NO: 5530 - protein, 6 aa, Conus distans
NKFVGR

SEQ ID NO: 5531 - protein, 4 aa, Conus ermineus
TRSK

SEQ ID NO: 5532 - protein, 6 aa, Conus ermineus
SVPRNK

SEQ ID NO: 5533 - protein, 3 aa, Conus ermineus
VGV

SEQ ID NO: 5534 - protein, 4 aa, Conus ermineus
LPAV

SEQ ID NO: 5535 - protein, 6 aa, Conus ebraeus
DTATRT

SEQ ID NO: 5536 - protein, 6 aa, Conus ebraeus
DTATRT

SEQ ID NO: 5537 - protein, 6 aa, Conus ebraeus
DTATRT

SEQ ID NO: 5538 - protein, 6 aa, Conus ebraeus
STATST

SEQ ID NO: 5539 - protein, 6 aa, Conus ebraeus
NLTINR

SEQ ID NO: 5540 - protein, 6 aa, Conus ebraeus
DTATRT

SEQ ID NO: 5541 - protein, 6 aa, Conus ebraeus
DTATRA

SEQ ID NO: 5542 - protein, 6 aa, Conus ebraeus
DTATRT

SEQ ID NO: 5543 - protein, 6 aa, Conus ebraeus
DTATRT

SEQ ID NO: 5544 - protein, 6 aa, Conus ebraeus
DTATRT

SEQ ID NO: 5545 - protein, 6 aa, Conus ebraeus
STATST

SEQ ID NO: 5546 - protein, 6 aa, Conus ebraeus
STATST

SEQ ID NO: 5547 - protein, 4 aa, Conus episcopatus
VALV

SEQ ID NO: 5548 - protein, 3 aa, Conus geographus
FLW

SEQ ID NO: 5549 - protein, 6 aa, Conus geographus
NPYTKR

SEQ ID NO: 5550 - protein, 6 aa, Conus geographus
LLYSNK

SEQ ID NO: 5551 - protein, 6 aa, Conus geographus
LSYSNK

SEQ ID NO: 5552 - protein, 3 aa, Conus generalis
LIV

SEQ ID NO: 5553 - protein, 3 aa, Conus textile
EGS

SEQ ID NO: 5554 - protein, 3 aa, Conus textile
DVV

SEQ ID NO: 5555 - protein, 3 aa, Conus textile
DVV

SEQ ID NO: 5556 - protein, 4 aa, Conus textile
YNGH

SEQ ID NO: 5557 - protein, 3 aa, Conus gloriamaris
VFF

SEQ ID NO: 5558 - protein, 3 aa, Conus gloriamaris
LGF

SEQ ID NO: 5559 - protein, 3 aa, Conus gloriamaris
VFF

SEQ ID NO: 5560 - protein, 3 aa, Conus gloriamaris
IFA

SEQ ID NO: 5561 - protein, 4 aa, Conus gloriamaris
GPFV

SEQ ID NO: 5562 - protein, 3 aa, Conus gloriamaris
VLF

SEQ ID NO: 5563 - protein, 8 aa, Conus imperialis
GDSTGKLI

SEQ ID NO: 5564 - protein, 6 aa, Conus judaeus
HEVFNT

SEQ ID NO: 5565 - protein, 6 aa, Conus judaeus
DMANNR

SEQ ID NO: 5566 - protein, 4 aa, Conus textile
FLMA

SEQ ID NO: 5567 - protein, 4 aa, Conus textile
VQFI

SEQ ID NO: 5568 - protein, 6 aa, Conus lividus
HTWAIM

SEQ ID NO: 5569 - protein, 3 aa, Conus litteratus
EQN

SEQ ID NO: 5570 - protein, 8 aa, Conus lividus
SGGHAGGL

SEQ ID NO: 5571 - protein, 4 aa, Conus lividus
GRHY

SEQ ID NO: 5572 - protein, 3 aa, Conus lividus
ARM

SEQ ID NO: 5573 - protein, 8 aa, Conus lividus
TSRNSGPT

SEQ ID NO: 5574 - protein, 3 aa, Conus leopardus
HVF

SEQ ID NO: 5575 - protein, 3 aa, Conus litteratus
ETY

SEQ ID NO: 5576 - protein, 7 aa, Conus litteratus
NEDFVPI

SEQ ID NO: 5577 - protein, 6 aa, Conus litteratus
NKEENV

SEQ ID NO: 5578 - protein, 6 aa, Conus litteratus
NVLRNR

SEQ ID NO: 5579 - protein, 8 aa, Conus litteratus
LVLQHKAV

SEQ ID NO: 5580 - protein, 8 aa, Conus litteratus
LVLQHKAV

SEQ ID NO: 5581 - protein, 4 aa, Conus litteratus
ILSY

SEQ ID NO: 5582 - protein, 4 aa, Conus lividus
FIVV

SEQ ID NO: 5583 - protein, 6 aa, Conus lividus
SHIGGM

SEQ ID NO: 5584 - protein, 6 aa, Conus lividus
THIGGM

SEQ ID NO: 5585 - protein, 6 aa, Conus lividus
SHIGGM

SEQ ID NO: 5586 - protein, 6 aa, Conus lividus
NHIGGM

SEQ ID NO: 5587 - protein, 6 aa, Conus lividus
NHIGGM

SEQ ID NO: 5588 - protein, 6 aa, Conus lividus
HTWAIM

SEQ ID NO: 5589 - protein, 6 aa, Conus lividus
HTWANV

SEQ ID NO: 5590 - protein, 6 aa, Conus miliaris
NLNSNK

SEQ ID NO: 5591 - protein, 6 aa, Conus miliaris
NPSSKR

SEQ ID NO: 5592 - protein, 6 aa, Conus miliaris
NIMAST

SEQ ID NO: 5593 - protein, 4 aa, Conus miliaris
TNNI

SEQ ID NO: 5594 - protein, 6 aa, Conus miliaris
STMSDV

SEQ ID NO: 5595 - protein, 4 aa, Conus miliaris
WRPR

SEQ ID NO: 5596 - protein, 6 aa, Conus miliaris
NLATKK

SEQ ID NO: 5597 - protein, 3 aa, Conus magus
LGF

SEQ ID NO: 5598 - protein, 4 aa, Conus magus
LSFV

SEQ ID NO: 5599 - protein, 3 aa, Conus magus
FLW

SEQ ID NO: 5600 - protein, 3 aa, Conus magus
ILW

SEQ ID NO: 5601 - protein, 4 aa, Conus magus
LSFV

SEQ ID NO: 5602 - protein, 4 aa, Conus magus
LSFV

SEQ ID NO: 5603 - protein, 4 aa, Conus magus
RSGK

SEQ ID NO: 5604 - protein, 4 aa, Conus magus
NRGK

SEQ ID NO: 5605 - protein, 5 aa, Conus magus
GRRGK

SEQ ID NO: 5606 - protein, 4 aa, Conus magus
NRGR

SEQ ID NO: 5607 - protein, 3 aa, Conus marmoreus
EMY

SEQ ID NO: 5608 - protein, 3 aa, Conus marmoreus
FLW

SEQ ID NO: 5609 - protein, 3 aa, Conus marmoreus
FAV

SEQ ID NO: 5610 - protein, 4 aa, Conus marmoreus
IVLV

SEQ ID NO: 5611 - protein, 3 aa, Conus marmoreus
VFV

SEQ ID NO: 5612 - protein, 10 aa, Conus marmoreus
LDYGGLGVGA

SEQ ID NO: 5613 - protein, 6 aa, Conus magus
NKTFGV

SEQ ID NO: 5614 - protein, 4 aa, Conus magus
ENSN

SEQ ID NO: 5615 - protein, 6 aa, Conus magus
NKIFGV

SEQ ID NO: 5616 - protein, 7 aa, Conus magus
TGRIFQT

SEQ ID NO: 5617 - protein, 8 aa, Conus miles
MTSGAGAI

SEQ ID NO: 5618 - protein, 6 aa, Conus miles
NKLIGV

SEQ ID NO: 5619 - protein, 8 aa, Conus miles
EGQSQGGL

SEQ ID NO: 5620 - protein, 6 aa, Conus miles
RRITDA

SEQ ID NO: 5621 - protein, 9 aa, Conus miles
MLREKQQPI

SEQ ID NO: 5622 - protein, 6 aa, Conus miliaris
STMSYV

SEQ ID NO: 5623 - protein, 6 aa, Conus miliaris
NLTIKR

SEQ ID NO: 5624 - protein, 6 aa, Conus miliaris
NFNSKS

SEQ ID NO: 5625 - protein, 8 aa, Conus miliaris
IDEGGSGV

SEQ ID NO: 5626 - protein, 4 aa, Conus miliaris
IILF

SEQ ID NO: 5627 - protein, 4 aa, Conus miliaris
FIVV

SEQ ID NO: 5628 - protein, 4 aa, Conus miliaris
FIVV

SEQ ID NO: 5629 - protein, 4 aa, Conus marmoreus
GPFV

SEQ ID NO: 5630 - protein, 4 aa, Conus marmoreus
GPFV

SEQ ID NO: 5631 - protein, 4 aa, Conus nigropunctatus
FSLF

SEQ ID NO: 5632 - protein, 4 aa, Conus omaria
IIFF

SEQ ID NO: 5633 - protein, 3 aa, Conus omaria
IFI

SEQ ID NO: 5634 - protein, 4 aa, Conus omaria
LLIA

SEQ ID NO: 5635 - protein, 4 aa, Conus omaria
VGAI

SEQ ID NO: 5636 - protein, 3 aa, Conus omaria
FFA

SEQ ID NO: 5637 - protein, 4 aa, Conus omaria
FLFF

SEQ ID NO: 5638 - protein, 4 aa, Conus purpurascens
IITI

SEQ ID NO: 5639 - protein, 4 aa, Conus purpurascens
IITI

SEQ ID NO: 5640 - protein, 4 aa, Conus purpurascens
IITI

SEQ ID NO: 5641 - protein, 4 aa, Conus purpurascens
LPAV

SEQ ID NO: 5642 - protein, 4 aa, Conus purpurascens
LPGV

SEQ ID NO: 5643 - protein, 5 aa, Conus purpurascens
NRFNK

SEQ ID NO: 5644 - protein, 4 aa, Conus pennaceus
VLIA

SEQ ID NO: 5645 - protein, 3 aa, Conus pennaceus
LRY

SEQ ID NO: 5646 - protein, 3 aa, Conus pennaceus
ATT

SEQ ID NO: 5647 - protein, 3 aa, Conus pennaceus
LFV

SEQ ID NO: 5648 - protein, 3 aa, Conus pennaceus
LFF

SEQ ID NO: 5649 - protein, 4 aa, Conus pennaceus
LGVM

SEQ ID NO: 5650 - protein, 4 aa, Conus pennaceus
VALV

SEQ ID NO: 5651 - protein, 4 aa, Conus pennaceus
VLIA

SEQ ID NO: 5652 - protein, 3 aa, Conus pennaceus
LFF

SEQ ID NO: 5653 - protein, 3 aa, Conus pennaceus
LFV

SEQ ID NO: 5654 - protein, 3 aa, Conus pennaceus
VFV

SEQ ID NO: 5655 - protein, 3 aa, Conus pennaceus
NRY

SEQ ID NO: 5656 - protein, 3 aa, Conus pennaceus
DGF

SEQ ID NO: 5657 - protein, 3 aa, Conus pennaceus
VFV

SEQ ID NO: 5658 - protein, 3 aa, Conus pennaceus
FFA

SEQ ID NO: 5659 - protein, 4 aa, Conus pennaceus
DQTY

SEQ ID NO: 5660 - protein, 3 aa, Conus pulicarius
LYV

SEQ ID NO: 5661 - protein, 3 aa, Conus pulicarius
AII

SEQ ID NO: 5662 - protein, 6 aa, Conus pulicarius
HKTIHA

SEQ ID NO: 5663 - protein, 3 aa, Conus quercinus
LFV

SEQ ID NO: 5664 - protein, 3 aa, Conus quercinus
LFV

SEQ ID NO: 5665 - protein, 4 aa, Conus quercinus
QGLT

SEQ ID NO: 5666 - protein, 6 aa, Conus radiates
KSYNKK

SEQ ID NO: 5667 - protein, 4 aa, Conus radiates
ESKF

SEQ ID NO: 5668 - protein, 4 aa, Conus striatus
RSGK

SEQ ID NO: 5669 - protein, 6 aa, Conus striatus
NPVTNM

SEQ ID NO: 5670 - protein, 4 aa, Conus striatus
AHHR

SEQ ID NO: 5671 - protein, 4 aa, Conus striatus
YRGK

SEQ ID NO: 5672 - protein, 5 aa, Conus striatus
GRRGK

SEQ ID NO: 5673 - protein, 8 aa, Conus striatus
AYSASKNV

SEQ ID NO: 5674 - protein, 3 aa, Conus striatus
LVW

SEQ ID NO: 5675 - protein, 4 aa, Conus striatus
RSGK

SEQ ID NO: 5676 - protein, 6 aa, Conus striatus
SPYSKI

SEQ ID NO: 5677 - protein, 6 aa, Conus striatus
AYFGKK

SEQ ID NO: 5678 - protein, 4 aa, Conus striatus
YRGK

SEQ ID NO: 5679 - protein, 4 aa, Conus striatus
YRGK

SEQ ID NO: 5680 - protein, 5 aa, Conus striatus
GRSGK

SEQ ID NO: 5681 - protein, 3 aa, Conus striatus
FLW

SEQ ID NO: 5682 - protein, 3 aa, Conus stercusmuscarum
FLW

SEQ ID NO: 5683 - protein, 9 aa, Conus spurius
FYSGGTFGI

SEQ ID NO: 5684 - protein, 4 aa, Conus striolatus
LPAV

SEQ ID NO: 5685 - protein, 4 aa, Conus striolatus
LFFV

SEQ ID NO: 5686 - protein, 6 aa, Conus striolatus
AYFGKI

SEQ ID NO: 5687 - protein, 6 aa, Conus tulipa
NPYSRK

SEQ ID NO: 5688 - protein, 4 aa, Conus tulipa
SRGK

SEQ ID NO: 5689 - protein, 4 aa, Conus textile
DRTY

SEQ ID NO: 5690 - protein, 4 aa, Conus textile
EASG

SEQ ID NO: 5691 - protein, 3 aa, Conus tessulatus
FFL

SEQ ID NO: 5692 - protein, 4 aa, Conus tessulatus
SSYY

SEQ ID NO: 5693 - protein, 3 aa, Conus tessulatus
ETY

SEQ ID NO: 5694 - protein, 3 aa, Conus tessulatus
ANV

SEQ ID NO: 5695 - protein, 3 aa, Conus tessulatus
ANV

SEQ ID NO: 5696 - protein, 3 aa, Conus tessulatus
ANV

SEQ ID NO: 5697 - protein, 3 aa, Conus tessulatus
ATA

SEQ ID NO: 5698 - protein, 4 aa, Conus textile
VVLS

SEQ ID NO: 5699 - protein, 4 aa, Conus textile
VQFI

SEQ ID NO: 5700 - protein, 4 aa, Conus textile
IFVS

SEQ ID NO: 5701 - protein, 3 aa, Conus textile
FFA

SEQ ID NO: 5702 - protein, 4 aa, Conus textile
IVLV

SEQ ID NO: 5703 - protein, 4 aa, Conus textile
IVFV

SEQ ID NO: 5704 - protein, 3 aa, Conus textile
EQN

SEQ ID NO: 5705 - protein, 5 aa, Conus textile
YKRAY

SEQ ID NO: 5706 - protein, 4 aa, Conus textile
DVTR

SEQ ID NO: 5707 - protein, 4 aa, Conus textile
DQTY

SEQ ID NO: 5708 - protein, 6 aa, Conus textile
SARTNR

SEQ ID NO: 5709 - protein, 4 aa, Conus textile
IVFV

SEQ ID NO: 5710 - protein, 4 aa, Conus textile
ILLF

SEQ ID NO: 5711 - protein, 4 aa, Conus textile
FLMA

SEQ ID NO: 5712 - protein, 3 aa, Conus textile
IFV

SEQ ID NO: 5713 - protein, 4 aa, Conus textile
TLFF

SEQ ID NO: 5714 - protein, 4 aa, Conus textile
ILLF

SEQ ID NO: 5715 - protein, 3 aa, Conus textile
IFV

SEQ ID NO: 5716 - protein, 3 aa, Conus textile
IFV

SEQ ID NO: 5717 - protein, 3 aa, Conus textile
FFA

SEQ ID NO: 5718 - protein, 4 aa, Conus textile
VVFW

SEQ ID NO: 5719 - protein, 4 aa, Conus textile
TLFF

SEQ ID NO: 5720 - protein, 3 aa, Conus textile
LGV

SEQ ID NO: 5721 - protein, 4 aa, Conus textile
VRSY

SEQ ID NO: 5722 - protein, 4 aa, Conus victoriae
VLAV

SEQ ID NO: 5723 - protein, 3 aa, Conus victoriae
FFA

SEQ ID NO: 5724 - protein, 3 aa, Conus victoriae
IFV

SEQ ID NO: 5725 - protein, 4 aa, Conus victoriae
ILLF

SEQ ID NO: 5726 - protein, 3 aa, Conus victoriae
VFV

SEQ ID NO: 5727 - protein, 4 aa, Conus victoriae
AQFI

SEQ ID NO: 5728 - protein, 4 aa, Conus vexillum
KGIY

SEQ ID NO: 5729 - protein, 8 aa, Conus virgo
DGQRQGGM

SEQ ID NO: 5730 - protein, 3 aa, Conus virgo
LIV

SEQ ID NO: 5731 - protein, 4 aa, Conus ventricosus
TGNY

SEQ ID NO: 5732 - protein, 3 aa, Conus ventricosus
FVV

SEQ ID NO: 5733 - protein, 3 aa, Conus ventricosus
FFV

SEQ ID NO: 5734 - protein, 3 aa, Conus ventricosus
IFV

SEQ ID NO: 5735 - protein, 3 aa, Conus ventricosus
LVI

SEQ ID NO: 5736 - protein, 4 aa, Conus ventricosus
TNNV

SEQ ID NO: 5737 - protein, 4 aa, Conus ventricosus
TNNV

SEQ ID NO: 5738 - protein, 8 aa, Conus ventricosus
RGPRQGPI

SEQ ID NO: 5739 - protein, 8 aa, Conus ventricosus
RGPHQGPI

SEQ ID NO: 5740 - protein, 8 aa, Conus ventricosus
TGPSQGPV

SEQ ID NO: 5741 - protein, 3 aa, Conus ventricosus
ATL

SEQ ID NO: 5742 - protein, 4 aa, Conus ventricosus
TGSY

SEQ ID NO: 5743 - protein, 3 aa, Conus ventricosus
ANL

SEQ ID NO: 5744 - protein, 3 aa, Conus ventricosus
VGG

SEQ ID NO: 5745 - protein, 3 aa, Conus ventricosus
VGV

SEQ ID NO: 5746 - protein, 4 aa, Conus ventricosus
DGTF

SEQ ID NO: 5747 - protein, 3 aa, Conus ventricosus
DAT

SEQ ID NO: 5748 - protein, 6 aa, Conus ventricosus
SSKTGR

SEQ ID NO: 5749 - protein, 3 aa, Conus ventricosus
DYY

SEQ ID NO: 5750 - protein, 3 aa, Conus ventricosus
DYY

SEQ ID NO: 5751 - protein, 3 aa, Conus ventricosus
FFV

SEQ ID NO: 5752 - protein, 3 aa, Conus ventricosus
LGV

SEQ ID NO: 5753 - protein, 6 aa, Conus vexillum
NKTFGV

SEQ ID NO: 5754 - protein, 8 aa, Conus vexillum
IDEGGRGV

SEQ ID NO: 5755 - protein, 7 aa, Conus geographus
GRGNPQK

SEQ ID NO: 5756 - protein, 5 aa, Conus arenatus
CQGNR

SEQ ID NO: 5757 - protein, 5 aa, Conus aulicus
CVGRR

SEQ ID NO: 5758 - protein, 4 aa, Conus betulinus
CWGG

SEQ ID NO: 5759 - protein, 5 aa, Conus betulinus
CFYDK

SEQ ID NO: 5760 - protein, 5 aa, Conus betulinus
CFYDK

SEQ ID NO: 5761 - protein, 4 aa, Conus capitaneus
CSGW

SEQ ID NO: 5762 - protein, 3 aa, Conus emaciatus
CGT

SEQ ID NO: 5763 - protein, 5 aa, Conus episcopatus
CYGQI

SEQ ID NO: 5764 - protein, 4 aa, Conus episcopatus
CRST

SEQ ID NO: 5765 - protein, 4 aa, Conus figulinus
CGGV

SEQ ID NO: 5766 - protein, 5 aa, Conus figulinus
CLGGI

SEQ ID NO: 5767 - protein, 5 aa, Conus figulinus
CLSGI

SEQ ID NO: 5768 - protein, 5 aa, Conus figulinus
CLSGI

SEQ ID NO: 5769 - protein, 4 aa, Conus imperialis
CWGY

SEQ ID NO: 5770 - protein, 4 aa, Conus imperialis
CIRE

SEQ ID NO: 5771 - protein, 4 aa, Conus imperialis
CWNV

SEQ ID NO: 5772 - protein, 5 aa, Conus lynceus
CIESM

SEQ ID NO: 5773 - protein, 5 aa, Conus magus
CPIGT

SEQ ID NO: 5774 - protein, 5 aa, Conus magus
CVNNK

SEQ ID NO: 5775 - protein, 5 aa, Conus magus
CLSGI

SEQ ID NO: 5776 - protein, 4 aa, Conus miles
CSGW

SEQ ID NO: 5777 - protein, 5 aa, Conus radiates
CLSGI

SEQ ID NO: 5778 - protein, 5 aa, Conus radiates
CLSGI

SEQ ID NO: 5779 - protein, 5 aa, Conus radiates
CLGGI

SEQ ID NO: 5780 - protein, 5 aa, Conus radiates
CLSGI

SEQ ID NO: 5781 - protein, 5 aa, Conus radiates
CLSGI

SEQ ID NO: 5782 - protein, 5 aa, Conus radiates
CLSGI

SEQ ID NO: 5783 - protein, 5 aa, Conus radiates
CLSGI

SEQ ID NO: 5784 - protein, 5 aa, Conus radiates
CLSGI

SEQ ID NO: 5785 - protein, 5 aa, Conus radiates
CPFGT

SEQ ID NO: 5786 - protein, 5 aa, Conus radiates
CPIGT

SEQ ID NO: 5787 - protein, 5 aa, Conus radiates
CFKGR

SEQ ID NO: 5788 - protein, 5 aa, Conus radiates
CPIGT

SEQ ID NO: 5789 - protein, 5 aa, Conus radiates
CLSGI

SEQ ID NO: 5790 - protein, 5 aa, Conus radiates
CLSGI

SEQ ID NO: 5791 - protein, 5 aa, Conus radiates
CLSGI

SEQ ID NO: 5792 - protein, 5 aa, Conus radiates
CLGGI

SEQ ID NO: 5793 - protein, 5 aa, Conus radiates
CLSGI

SEQ ID NO: 5794 - protein, 5 aa, Conus radiates
CFHGK

SEQ ID NO: 5795 - protein, 8 aa, Conus regius
CQYPEDAV

SEQ ID NO: 5796 - protein, 5 aa, Conus striatus
CPIGT

SEQ ID NO: 5797 - protein, 4 aa, Conus striatus
CSGL

SEQ ID NO: 5798 - protein, 4 aa, Conus spurius
CRGE

SEQ ID NO: 5799 - protein, 4 aa, Conus striolatus
CWGG

SEQ ID NO: 5800 - protein, 4 aa, Conus textile
CRWT

SEQ ID NO: 5801 - protein, 3 aa, Conus virgo
CGT

SEQ ID NO: 5802 - protein, 3 aa, Conus vexillum
CDT

SEQ ID NO: 5803 - protein, 3 aa, Conus vexillum
CDT

SEQ ID NO: 5804 - protein, 6 aa, Cladosporium fulvum
DFHKLQ

SEQ ID NO: 5805 - protein, 6 aa, Aspergillus clavatus
NTKEGV

SEQ ID NO: 5806 - protein, 4 aa, Aspergillus terreus
VNFV

SEQ ID NO: 5807 - protein, 6 aa, Neosartorya fischeri
DMRSLT

SEQ ID NO: 5808 - protein, 12 aa, Botryotinia fuckeliana
ALAHGGKADVGF

SEQ ID NO: 5809 - protein, 4 aa, Botryotinia fuckeliana
NSGE

SEQ ID NO: 5810 - protein, 12 aa, Sclerotinia sclerotiorium
ALAHGGKANVGY

SEQ ID NO: 5811 - protein, 9 aa, Laccaria bicolor
APFGPFGGS

SEQ ID NO: 5812 - protein, 10 aa, Laccaria bicolor
FPVPFGNGGV

SEQ ID NO: 5813 - protein, 12 aa, Laccaria bicolor
KISLSAVGLGLR

SEQ ID NO: 5814 - protein, 16 aa, Laccaria bicolor
VVFESSPLSRTVFVDW

SEQ ID NO: 5815 - protein, 11 aa, Laccaria bicolor
YPFAPEMVYGF

SEQ ID NO: 5816 - protein, 11 aa, Laccaria bicolor
LIIPPTIVLGF

SEQ ID NO: 5817 - protein, 11 aa, Laccaria bicolor
NSIPLIFVLGF

SEQ ID NO: 5818 - protein, 8 aa, Chaetomium globosum
GIFDEDAL

SEQ ID NO: 5819 - protein, 8 aa, Neurospora crassa
VSADGESV

SEQ ID NO: 5820 - protein, 1 aa, Astyanax mexicanus
G

SEQ ID NO: 5821 - protein, 1 aa, Astyanax mexicanus
G

SEQ ID NO: 5822 - protein, 1 aa, Astyanax mexicanus
G

SEQ ID NO: 5823 - protein, 1 aa, Astyanax mexicanus
G

SEQ ID NO: 5824 - protein, 1 aa, Astyanax mexicanus
G

SEQ ID NO: 5825 - protein, 1 aa, Paracentrotus lividus
G

SEQ ID NO: 5826 - protein, 1 aa, Paracentrotus lividus
G

SEQ ID NO: 5827 - protein, 1 aa, Sparus aurata
G

SEQ ID NO: 5828 - protein, 1 aa, Sparus aurata
E

SEQ ID NO: 5829 - protein, 1 aa, Homo sapiens
E

SEQ ID NO: 5830 - protein, 1 aa, Homo sapiens
G

SEQ ID NO: 5831 - protein, 1 aa, Homo sapiens
G

SEQ ID NO: 5832 - protein, 1 aa, Homo sapiens
G

SEQ ID NO: 5833 - protein, 1 aa, Paralabidochromis chilotes
G

SEQ ID NO: 5834 - protein, 1 aa, Danio rerio
Q

SEQ ID NO: 5835 - protein, 1 aa, Sus scrofa
G

SEQ ID NO: 5836 - protein, 1 aa, Sus scrofa
G

SEQ ID NO: 5837 - protein, 1 aa, Anas platyrhynchos
G

SEQ ID NO: 5838 - protein, 1 aa, Anas platyrhynchos
G

SEQ ID NO: 5839 - protein, 1 aa, Oryzias latipes
E

SEQ ID NO: 5840 - protein, 1 aa, Bos Taurus
G

SEQ ID NO: 5841 - protein, 1 aa, Capra hircus
G

SEQ ID NO: 5842 - protein, 1 aa, Bos Taurus
G

SEQ ID NO: 5843 - protein, 1 aa, Oryctolagus cuniculus
G

SEQ ID NO: 5844 - protein, 1 aa, Sus scrofa
G

SEQ ID NO: 5845 - protein, 1 aa, Nematostella vectensis
G

SEQ ID NO: 5846 - protein, 1 aa, Nematostella vectensis
G

SEQ ID NO: 5847 - protein, 1 aa, Nematostella vectensis
G

SEQ ID NO: 5848 - protein, 1 aa, Danio rerio
G

SEQ ID NO: 5849 - protein, 1 aa, Homo sapiens
G

SEQ ID NO: 5850 - protein, 1 aa, Homo sapiens
G

SEQ ID NO: 5851 - protein, 1 aa, Sus scrofa
G

SEQ ID NO: 5852 - protein, 1 aa, Ovis aries
G

SEQ ID NO: 5853 - protein, 1 aa, Xenopus tropicalis
G

SEQ ID NO: 5854 - protein, 1 aa, Xenopus tropicalis
E

SEQ ID NO: 5855 - protein, 1 aa, Papio anubis
G

SEQ ID NO: 5856 - protein, 1 aa, Papio anubis
G

SEQ ID NO: 5857 - protein, 1 aa, Ovis aries
E

SEQ ID NO: 5858 - protein, 1 aa, Callithrix jacchus
G

SEQ ID NO: 5859 - protein, 1 aa, Sistrurus catenatus edwardsii
E

SEQ ID NO: 5860 - protein, 1 aa, Sistrurus catenatus edwardsii
E

SEQ ID NO: 5861 - protein, 1 aa, Culex quinquefasciatus
G

SEQ ID NO: 5862 - protein, 1 aa, Homo sapiens
G

SEQ ID NO: 5863 - protein, 1 aa, Callicebus moloch
G

SEQ ID NO: 5864 - protein, 1 aa, Ambystoma mexicanum
G

SEQ ID NO: 5865 - protein, 1 aa, Ochotona curzoniae
E

SEQ ID NO: 5866 - protein, 1 aa, Ochotona curzoniae
E

SEQ ID NO: 5867 - protein, 1 aa, Rhinolophus ferrumequinum
G

SEQ ID NO: 5868 - protein, 1 aa, Rhinolophus ferrumequinum
G

SEQ ID NO: 5869 - protein, 1 aa, Ovis aries
G

SEQ ID NO: 5870 - protein, 1 aa, Capra hircus
G

SEQ ID NO: 5871 - protein, 1 aa, Mus musculus
G

SEQ ID NO: 5872 - protein, 1 aa, Homo sapiens
G

SEQ ID NO: 5873 - protein, 1 aa, Danio rerio
G

SEQ ID NO: 5874 - protein, 1 aa, Danio rerio
G

SEQ ID NO: 5875 - protein, 1 aa, Strongylocentrotus purpuratus
G

SEQ ID NO: 5876 - protein, 1 aa, Drosophila erecta
G

SEQ ID NO: 5877 - protein, 1 aa, Sorex araneus
G

SEQ ID NO: 5878 - protein, 1 aa, Sorex araneus
G

SEQ ID NO: 5879 - protein, 1 aa, Saccostrea kegaki
G

SEQ ID NO: 5880 - protein, 1 aa, Homo sapiens
G

SEQ ID NO: 5881 - protein, 1 aa, Drosophilia grimshawi
G

SEQ ID NO: 5882 - protein, 1 aa, Drosophilia mojavensis
G

SEQ ID NO: 5883 - protein, 1 aa, Drosophilia virilis
G

SEQ ID NO: 5884 - protein, 1 aa, Drosophilia willistoni
G

SEQ ID NO: 5885 - protein, 1 aa, Drosophilia yakuba
G

SEQ ID NO: 5886 - protein, 1 aa, Drosophilia simulans
G

SEQ ID NO: 5887 - protein, 1 aa, Sus scrofa
E

SEQ ID NO: 5888 - protein, 1 aa, Xenopus tropicalis
G

SEQ ID NO: 5889 - protein, 1 aa, Homo sapiens
E

SEQ ID NO: 5890 - protein, 1 aa, Rattus norvegicus
E

SEQ ID NO: 5891 - protein, 1 aa, Otolemur garnettii
G

SEQ ID NO: 5892 - protein, 1 aa, Otolemur garnettii
G

SEQ ID NO: 5893 - protein, 1 aa, Salmo salar
G

SEQ ID NO: 5894 - protein, 1 aa, Sus scrofa
E

SEQ ID NO: 5895 - protein, 1 aa, Branchiostoma floridae
G

SEQ ID NO: 5896 - protein, 1 aa, Branchiostoma floridae
G

SEQ ID NO: 5897 - protein, 1 aa, Branchiostoma floridae
G

SEQ ID NO: 5898 - protein, 1 aa, Branchiostoma floridae
G

SEQ ID NO: 5899 - protein, 1 aa, Branchiostoma floridae
G

SEQ ID NO: 5900 - protein, 1 aa, Branchiostoma floridae
G

SEQ ID NO: 5901 - protein, 1 aa, Stylophora pistillata
G

SEQ ID NO: 5902 - protein, 1 aa, Acropora sp. DZ-2008
G

SEQ ID NO: 5903 - protein, 1 aa, Pseudocowpox virus
D

SEQ ID NO: 5904 - protein, 1 aa, Pseudocowpox virus
D

SEQ ID NO: 5905 - protein, 1 aa, Labidochromis caeruleus
G

SEQ ID NO: 5906 - protein, 1 aa, Oryctolagus cuniculus
G

SEQ ID NO: 5907 - protein, 1 aa, Ixodes scapularis
G

SEQ ID NO: 5908 - protein, 1 aa, Xenopus laevis
G

SEQ ID NO: 5909 - protein, 1 aa, Xenopus laevis
G

SEQ ID NO: 5910 - protein, 1 aa, Xenopus laevis
G

SEQ ID NO: 5911 - protein, 1 aa, Danio rerio
Q

SEQ ID NO: 5912 - protein, 1 aa, Salmo salar
G

SEQ ID NO: 5913 - protein, 1 aa, Gadus morhua
G

SEQ ID NO: 5914 - protein, 1 aa, Bombyx mori
G

SEQ ID NO: 5915 - protein, 1 aa, Mus musculus
G

SEQ ID NO: 5916 - protein, 1 aa, Salmo salar
G

SEQ ID NO: 5917 - protein, 1 aa, Bitis arietans
E

SEQ ID NO: 5918 - protein, 1 aa, Agkistrodon piscivorus piscivorus
E

SEQ ID NO: 5919 - protein, 1 aa, Crotalus atrox
E

SEQ ID NO: 5920 - protein, 1 aa, Agkistrodon piscivorus piscivorus
E

SEQ ID NO: 5921 - protein, 1 aa, Vipera ammodytes ammodytes
E

SEQ ID NO: 5922 - protein, 1 aa, Protobothrops flavoviridis
E

SEQ ID NO: 5923 - protein, 1 aa, Protobothrops flavoviridis
E

SEQ ID NO: 5924 - protein, 1 aa, Vipera ammodytes ammodytes
E

SEQ ID NO: 5925 - protein, 1 aa, Daboia russelli russelli
E

SEQ ID NO: 5926 - protein, 1 aa, Osmerus mordax
E

SEQ ID NO: 5927 - protein, 1 aa, Anoplopoma fimbria
E

SEQ ID NO: 5928 - protein, 1 aa, Dasypus novemcinctus
G

SEQ ID NO: 5929 - protein, 1 aa, Myotis ricketti
G

SEQ ID NO: 5930 - protein, 1 aa, Danio rerio
G

SEQ ID NO: 5931 - protein, 1 aa, Danio rerio
G

SEQ ID NO: 5932 - protein, 1 aa, Danio rerio
G

SEQ ID NO: 5933 - protein, 1 aa, Dama dama
G

SEQ ID NO: 5934 - protein, 1 aa, Danio rerio
G

SEQ ID NO: 5935 - protein, 1 aa, Xenopus laevis
E

SEQ ID NO: 5936 - protein, 1 aa, Xenopus laevis
E

SEQ ID NO: 5937 - protein, 1 aa, Oryctolagus cuniculus
G

SEQ ID NO: 5938 - protein, 1 aa, Oryctolagus cuniculus
G

SEQ ID NO: 5939 - protein, 1 aa, Danio rerio
G

SEQ ID NO: 5940 - protein, 1 aa, Danio rerio
G

SEQ ID NO: 5941 - protein, 1 aa, Danio rerio
E

SEQ ID NO: 5942 - protein, 1 aa, Danio rerio
E

SEQ ID NO: 5943 - protein, 1 aa, Xenopus laevis
G

SEQ ID NO: 5944 - protein, 1 aa, Halocynthia roretzi
G

SEQ ID NO: 5945 - protein, 1 aa, Ovis aries
E

SEQ ID NO: 5946 - protein, 1 aa, Rattus norvegicus
S

SEQ ID NO: 5947 - protein, 1 aa, Danio rerio
G

SEQ ID NO: 5948 - protein, 1 aa, Gallus gallus
G

SEQ ID NO: 5949 - protein, 1 aa, Branchiostoma floridae
G

SEQ ID NO: 5950 - protein, 1 aa, Crassostrea gigas
G

SEQ ID NO: 5951 - protein, 1 aa, Drosophilia melanogaster
G

SEQ ID NO: 5952 - protein, 1 aa, Homo sapiens
G

SEQ ID NO: 5953 - protein, 1 aa, Homo sapiens
G

SEQ ID NO: 5954 - protein, 1 aa, Bos Taurus
E

SEQ ID NO: 5955 - protein, 1 aa, Bos Taurus
E

SEQ ID NO: 5956 - protein, 1 aa, Bos Taurus
E

SEQ ID NO: 5957 - protein, 1 aa, Bos Taurus
E

SEQ ID NO: 5958 - protein, 1 aa, Bos Taurus
E

SEQ ID NO: 5959 - protein, 1 aa, Bos Taurus
E

SEQ ID NO: 5960 - protein, 1 aa, Bos Taurus
E

SEQ ID NO: 5961 - protein, 1 aa, Bos Taurus
E

SEQ ID NO: 5962 - protein, 1 aa, Bos Taurus
E

SEQ ID NO: 5963 - protein, 1 aa, Bos Taurus
E

SEQ ID NO: 5964 - protein, 1 aa, Bos Taurus
E

SEQ ID NO: 5965 - protein, 1 aa, Bos Taurus
E

SEQ ID NO: 5966 - protein, 1 aa, Rattus norvegicus
E

SEQ ID NO: 5967 - protein, 1 aa, Rattus norvegicus
E

SEQ ID NO: 5968 - protein, 1 aa, Rattus norvegicus
E

SEQ ID NO: 5969 - protein, 1 aa, Rattus norvegicus
E

SEQ ID NO: 5970 - protein, 1 aa, Homo sapiens
G

SEQ ID NO: 5971 - protein, 1 aa, Mus musculus
G

SEQ ID NO: 5972 - protein, 1 aa, Mus musculus
G

SEQ ID NO: 5973 - protein, 1 aa, Mus musculus
G

SEQ ID NO: 5974 - protein, 1 aa, Homo sapiens
G

SEQ ID NO: 5975 - protein, 1 aa, Homo sapiens
G

SEQ ID NO: 5976 - protein, 1 aa, Mus musculus
G

SEQ ID NO: 5977 - protein, 1 aa, Xenopus laevis
G

SEQ ID NO: 5978 - protein, 1 aa, Cavia porcellus
E

SEQ ID NO: 5979 - protein, 1 aa, Xenopus laevis
G

SEQ ID NO: 5980 - protein, 1 aa, Xenopus laevis
G

SEQ ID NO: 5981 - protein, 1 aa, Danio rerio
G

SEQ ID NO: 5982 - protein, 1 aa, Homo sapiens
G

SEQ ID NO: 5983 - protein, 1 aa, Mus musculus
G

SEQ ID NO: 5984 - protein, 1 aa, Mus musculus
G

SEQ ID NO: 5985 - protein, 1 aa, Mus musculus
G

SEQ ID NO: 5986 - protein, 1 aa, Mus musculus
G

SEQ ID NO: 5987 - protein, 1 aa, Strongylocentrotus purpuratus
G

SEQ ID NO: 5988 - protein, 1 aa, Strongylocentrotus purpuratus
G

SEQ ID NO: 5989 - protein, 1 aa, Rattus norvegicus
G

SEQ ID NO: 5990 - protein, 1 aa, Mus musculus
G

SEQ ID NO: 5991 - protein, 1 aa, Sus scrofa
E

SEQ ID NO: 5992 - protein, 1 aa, Homo sapiens
E

SEQ ID NO: 5993 - protein, 1 aa, Homo sapiens
E

SEQ ID NO: 5994 - protein, 1 aa, Homo sapiens
E

SEQ ID NO: 5995 - protein, 1 aa, Mus musculus
E

SEQ ID NO: 5996 - protein, 1 aa, Ovis aries
E

SEQ ID NO: 5997 - protein, 1 aa, Bos taurus
G

SEQ ID NO: 5998 - protein, 1 aa, Protobothrops flavoviridis
E

SEQ ID NO: 5999 - protein, 1 aa, Protobothrops flavoviridis
E

SEQ ID NO: 6000 - protein, 1 aa, Protobothrops flavoviridis
E

SEQ ID NO: 6001 - protein, 1 aa, Daboia russelli russelli
E

SEQ ID NO: 6002 - protein, 1 aa, Protobothrops flavoviridis
E

SEQ ID NO: 6003 - protein, 1 aa, Vipera ammodytes ammodytes
E

SEQ ID NO: 6004 - protein, 1 aa, Gallus gallus
D

SEQ ID NO: 6005 - protein, 1 aa, Coturnix coturnix japonica
D

SEQ ID NO: 6006 - protein, 1 aa, Coturnix coturnix japonica
D

SEQ ID NO: 6007 - protein, 1 aa, Coturnix coturnix japonica
D

SEQ ID NO: 6008 - protein, 1 aa, Coturnix coturnix japonica
D

SEQ ID NO: 6009 - protein, 1 aa, Macrovipera lebetina
E

SEQ ID NO: 6010 - protein, 1 aa, Bitis gabonica
E

SEQ ID NO: 6011 - protein, 1 aa, Viper aspis aspis
E

SEQ ID NO: 6012 - protein, 1 aa, Danio rerio
G

SEQ ID NO: 6013 - protein, 1 aa, Gallus gallus
G

SEQ ID NO: 6014 - protein, 1 aa, Drosophilia simulans
G

SEQ ID NO: 6015 - protein, 1 aa, Drosophilia virilis
G

SEQ ID NO: 6016 - protein, 1 aa, Mus musculus
E

SEQ ID NO: 6017 - protein, 1 aa, Mus musculus
E

SEQ ID NO: 6018 - protein, 1 aa, Mus musculus
E

SEQ ID NO: 6019 - protein, 1 aa, Mus musculus
L

SEQ ID NO: 6020 - protein, 1 aa, Rattus norvegicus
G

SEQ ID NO: 6021 - protein, 1 aa, Rattus norvegicus
G

SEQ ID NO: 6022 - protein, 1 aa, Xenopus tropicalis
E

SEQ ID NO: 6023 - protein, 1 aa, Nematostella vectensis
G

SEQ ID NO: 6024 - protein, 1 aa, Danio rerio
Q

SEQ ID NO: 6025 - protein, 1 aa, Aedes aegypti
G

SEQ ID NO: 6026 - protein, 1 aa, Pantholops hodgsonii
E

SEQ ID NO: 6027 - protein, 1 aa, Danio rerio
Q

SEQ ID NO: 6028 - protein, 1 aa, Danio rerio
Q

SEQ ID NO: 6029 - protein, 1 aa, Saccoglossus kowalevskii
G

SEQ ID NO: 6030 - protein, 1 aa, Saccoglossus kowalevskii
G

SEQ ID NO: 6031 - protein, 1 aa, Drosophila yakuba
G

SEQ ID NO: 6032 - protein, 1 aa, Drosophila teissieri
G

SEQ ID NO: 6033 - protein, 1 aa, Drosophila orena
G

SEQ ID NO: 6034 - protein, 1 aa, Junonia coenia
G

SEQ ID NO: 6035 - protein, 1 aa, Schistocerca Americana
G

SEQ ID NO: 6036 - protein, 1 aa, Nematostella vectensis
G

SEQ ID NO: 6037 - protein, 1 aa, Dama dama
G

SEQ ID NO: 6038 - protein, 1 aa, Bos taurus
G

SEQ ID NO: 6039 - protein, 1 aa, Eleutherodactylus coqui
G

SEQ ID NO: 6040 - protein, 1 aa, Homo sapiens
G

SEQ ID NO: 6041 - protein, 1 aa, Didelphis albiventris
G

SEQ ID NO: 6042 - protein, 1 aa, Platynereis dumerilii
G

SEQ ID NO: 6043 - protein, 1 aa, Nematostella vectensis
G

SEQ ID NO: 6044 - protein, 1 aa, Protobothrops mucrosquamatus
E

SEQ ID NO: 6045 - protein, 1 aa, Anguilla japonica
D

SEQ ID NO: 6046 - protein, 1 aa, Amphiura filiformis
G

SEQ ID NO: 6047 - protein, 1 aa, Equus caballus
G

SEQ ID NO: 6048 - protein, 1 aa, Mus musculus
G

SEQ ID NO: 6049 - protein, 1 aa, Mus musculus
G

SEQ ID NO: 6050 - protein, 1 aa, Mus musculus
G

SEQ ID NO: 6051 - protein, 1 aa, Mus musculus
G

SEQ ID NO: 6052 - protein, 1 aa, Mus musculus
G

SEQ ID NO: 6053 - protein, 1 aa, Mus musculus
G

SEQ ID NO: 6054 - protein, 1 aa, Ciona intestinalis
G

SEQ ID NO: 6055 - protein, 1 aa, Homo sapiens
G

SEQ ID NO: 6056 - protein, 1 aa, Bos taurus
G

SEQ ID NO: 6057 - protein, 1 aa, Macaca fascicularis
G

SEQ ID NO: 6058 - protein, 1 aa, Tetraodon nigroviridis
E

SEQ ID NO: 6059 - protein, 1 aa, Tetraodon nigroviridis
G

SEQ ID NO: 6060 - protein, 1 aa, Tetraodon nigroviridis
G

SEQ ID NO: 6061 - protein, 1 aa, Tetraodon nigroviridis
E

SEQ ID NO: 6062 - protein, 1 aa, Tetraodon nigroviridis
G

SEQ ID NO: 6063 - protein, 1 aa, Tetraodon nigroviridis
V

SEQ ID NO: 6064 - protein, 1 aa, Tetraodon nigroviridis
G

SEQ ID NO: 6065 - protein, 1 aa, Orf virus
D

SEQ ID NO: 6066 - protein, 1 aa, Homo sapiens
G

SEQ ID NO: 6067 - protein, 1 aa, Homo sapiens
G

SEQ ID NO: 6068 - protein, 1 aa, Homo sapiens
E

SEQ ID NO: 6069 - protein, 1 aa, Gallus gallus
D

SEQ ID NO: 6070 - protein, 1 aa, Rattus norvegicus
E

SEQ ID NO: 6071 - protein, 1 aa, Mus musculus
E

SEQ ID NO: 6072 - protein, 1 aa, Xenopus laevis
G

SEQ ID NO: 6073 - protein, 1 aa, Amphiura filiformis
G

SEQ ID NO: 6074 - protein, 1 aa, Homo sapiens
E

SEQ ID NO: 6075 - protein, 1 aa, Bos taurus
G

SEQ ID NO: 6076 - protein, 1 aa, Danio rerio
Q

SEQ ID NO: 6077 - protein, 1 aa, Danio rerio
G

SEQ ID NO: 6078 - protein, 1 aa, Nematostella vectensis
G

SEQ ID NO: 6079 - protein, 1 aa, Rattus norvegicus
E

SEQ ID NO: 6080 - protein, 1 aa, Rattus norvegicus
E

SEQ ID NO: 6081 - protein, 1 aa, Xenopus tropicalis
G

SEQ ID NO: 6082 - protein, 1 aa, Xenopus laevis
G

SEQ ID NO: 6083 - protein, 1 aa, Rattus norvegicus
G

SEQ ID NO: 6084 - protein, 1 aa, Trachemys scripta
G

SEQ ID NO: 6085 - protein, 1 aa, Oncohynchus mykiss
E

SEQ ID NO: 6086 - protein, 1 aa, Oncorhynchus mykiss
E

SEQ ID NO: 6087 - protein, 1 aa, Rattus norvegicus
G

SEQ ID NO: 6088 - protein, 1 aa, Petromyzon marinus
G

SEQ ID NO: 6089 - protein, 1 aa, Petromyzon marinus
G

SEQ ID NO: 6090 - protein, 1 aa, Petromyzon marinus
G

SEQ ID NO: 6091 - protein, 1 aa, Bothrops erythromelas
E

SEQ ID NO: 6092 - protein, 1 aa, Homo sapiens
G

SEQ ID NO: 6093 - protein, 1 aa, Xenopus tropicalis
G

SEQ ID NO: 6094 - protein, 1 aa, Xenopus laevis
G

SEQ ID NO: 6095 - protein, 1 aa, Bovine popular stomatitis virus
E

SEQ ID NO: 6096 - protein, 1 aa, Equus caballus
G

SEQ ID NO: 6097 - protein, 1 aa, Bovine popular stomatitis virus
E

SEQ ID NO: 6098 - protein, 1 aa, Homo sapiens
L

SEQ ID NO: 6099 - protein, 1 aa, Gallus gallus
G

SEQ ID NO: 6100 - protein, 1 aa, Mus musculus
E

SEQ ID NO: 6101 - protein, 1 aa, Paralichthys olivaceus
G

SEQ ID NO: 6102 - protein, 1 aa, Homo sapiens
G

SEQ ID NO: 6103 - protein, 1 aa, Athalia rosae
G

SEQ ID NO: 6104 - protein, 1 aa, Orv virus strain D1701
D

SEQ ID NO: 6105 - protein, 1 aa, Tanganicodus irsacae
G

SEQ ID NO: 6106 - protein, 1 aa, Ophthalmotilapia nasuta
G

SEQ ID NO: 6107 - protein, 1 aa, Haplotaxodon microlepis
G

SEQ ID NO: 6108 - protein, 1 aa, Gnathochromis permaxillaris
G

SEQ ID NO: 6109 - protein, 1 aa, Anopheles gambiae
G

SEQ ID NO: 6110 - protein, 1 aa, Danio rerio
G

SEQ ID NO: 6111 - protein, 1 aa, Homo sapiens
G

SEQ ID NO: 6112 - protein, 1 aa, Tetraodon nigroviridis
G

SEQ ID NO: 6113 - protein, 1 aa, Takifugu rubripes
G

SEQ ID NO: 6114 - protein, 1 aa, Rattus norvegicus
G

SEQ ID NO: 6115 - protein, 1 aa, Oryctolagus cuniculus
E

SEQ ID NO: 6116 - protein, 1 aa, Parasteatoda tepidariorum
G

SEQ ID NO: 6117 - protein, 1 aa, Ilyanassa obsolete
G

SEQ ID NO: 6118 - protein, 1 aa, Mus musculus
G

SEQ ID NO: 6119 - protein, 1 aa, Mus musculus
G

SEQ ID NO: 6120 - protein, 1 aa, Mus musculus
G

SEQ ID NO: 6121 - protein, 1 aa, Mustela vison
E

SEQ ID NO: 6122 - protein, 1 aa, Ovis aries
E

SEQ ID NO: 6123 - protein, 1 aa, Stichopus japonicas
G

SEQ ID NO: 6124 - protein, 1 aa, Boulengerochromis microlepis
G

SEQ ID NO: 6125 - protein, 1 aa, Talapia rendalli
G

SEQ ID NO: 6126 - protein, 1 aa, Tropheus duboisi
G

SEQ ID NO: 6127 - protein, 1 aa, Steatocranus casuarius
G

SEQ ID NO: 6128 - protein, 1 aa, Oreochromis niloticus
G

SEQ ID NO: 6129 - protein, 1 aa, Labidochromis caeruleus
G

SEQ ID NO: 6130 - protein, 1 aa, Julidochromis transcriptus
G

SEQ ID NO: 6131 - protein, 1 aa, Pundamilia nyererei
G

SEQ ID NO: 6132 - protein, 1 aa, Haplochromis burtoni
G

SEQ ID NO: 6133 - protein, 1 aa, Cyprichromis leptosome
G

SEQ ID NO: 6134 - protein, 1 aa, Ctenochromis horei
G

SEQ ID NO: 6135 - protein, 1 aa, Astatoreochromis alluaudi
G

SEQ ID NO: 6136 - protein, 1 aa, Suncus murinus
G

SEQ ID NO: 6137 - protein, 1 aa, Patella vulgata
G

SEQ ID NO: 6138 - protein, 1 aa, Acropora millepora
G

SEQ ID NO: 6139 - protein, 1 aa, Hemicentrotus pulcherrimus
G

SEQ ID NO: 6140 - protein, 1 aa, Equus caballus
E

SEQ ID NO: 6141 - protein, 1 aa, Sus scrofa
E

SEQ ID NO: 6142 - protein, 1 aa, Sus scrofa
E

SEQ ID NO: 6143 - protein, 1 aa, Archaster typicus
G

SEQ ID NO: 6144 - protein, 1 aa, Gallus gallus
G

SEQ ID NO: 6145 - protein, 1 aa, Gallus gallus
G

SEQ ID NO: 6146 - protein, 1 aa, Gallus gallus
G

SEQ ID NO: 6147 - protein, 1 aa, Bothrops jararaca
E

SEQ ID NO: 6148 - protein, 1 aa, Bothrops insularis
E

SEQ ID NO: 6149 - protein, 1 aa, Lampetra japonica
G

SEQ ID NO: 6150 - protein, 1 aa, Lampetra japonica
G

SEQ ID NO: 6151 - protein, 1 aa, Xenopus tropicalis
G

SEQ ID NO: 6152 - protein, 1 aa, Xenopus tropicalis
G

SEQ ID NO: 6153 - protein, 1 aa, Gallus gallus
G

SEQ ID NO: 6154 - protein, 1 aa, Xenopus laevis
G

SEQ ID NO: 6155 - protein, 1 aa, Felis catus
E

SEQ ID NO: 6156 - protein, 1 aa, Macaca fascicularis
E

SEQ ID NO: 6157 - protein, 1 aa, Schistocerca gregaria
G

SEQ ID NO: 6158 - protein, 1 aa, Gallus Gallus
G

SEQ ID NO: 6159 - protein, 1 aa, Mesocricetus auratus
E

SEQ ID NO: 6160 - protein, 1 aa, Macaca mulatta
E

SEQ ID NO: 6161 - protein, 1 aa, Chlorocebus aethiops
G

SEQ ID NO: 6162 - protein, 1 aa, Macaca fascicularis
G

SEQ ID NO: 6163 - protein, 1 aa, Xenopus laevis
S

SEQ ID NO: 6164 - protein, 1 aa, Mesocricetus auratus
E

SEQ ID NO: 6165 - protein, 1 aa, Callithrix jacchus
E

SEQ ID NO: 6166 - protein, 1 aa, Equus caballus
E

SEQ ID NO: 6167 - protein, 1 aa, Gallus gallus
G

SEQ ID NO: 6168 - protein, 1 aa, Canis familiaris
E

SEQ ID NO: 6169 - protein, 1 aa, Canis familiaris
E

SEQ ID NO: 6170 - protein, 1 aa, Canis familiaris
E

SEQ ID NO: 6171 - protein, 1 aa, Ovis aries
E

SEQ ID NO: 6172 - protein, 1 aa, Canis familiaris
G

SEQ ID NO: 6173 - protein, 1 aa, Danio rerio
G

SEQ ID NO: 6174 - protein, 1 aa, Spalax ehrenbergi
E

SEQ ID NO: 6175 - protein, 1 aa, Branchiostoma belcheri
G

SEQ ID NO: 6176 - protein, 1 aa, Ptychodera flava
G

SEQ ID NO: 6177 - protein, 1 aa, Danio rerio
G

SEQ ID NO: 6178 - protein, 1 aa, Gallus gallus
G

SEQ ID NO: 6179 - protein, 1 aa, Xenopus laevis
G

SEQ ID NO: 6180 - protein, 1 aa, Bos taurus
E

SEQ ID NO: 6181 - protein, 1 aa, Lytechinus variegatus
G

SEQ ID NO: 6182 - protein, 1 aa, Strongylocentrotus purpuratus
G

SEQ ID NO: 6183 - protein, 1 aa, Tripneustes gratilla
G

SEQ ID NO: 6184 - protein, 1 aa, Xenopus laevis
G

SEQ ID NO: 6185 - protein, 1 aa, Xenopus laevis
G

SEQ ID NO: 6186 - protein, 1 aa, Orf virus
D

SEQ ID NO: 6187 - protein, 9 aa, Gymnema sylvestre
KKVNWWDHK

SEQ ID NO: 6188 - protein, 10 aa, Acrocinus longimanus
HKEPGWVAGY

SEQ ID NO: 6189 - protein, 10 aa, Acrocinus longimanus
HKEPGWVAGY

SEQ ID NO: 6190 - protein, 10 aa, Acrocinus longimanus
HKQPGWVAGY

SEQ ID NO: 6191 - protein, 9 aa, Pimpla hypochondriaca
QPRKNGPSM

SEQ ID NO: 6192 - protein, 6 aa, Pimpla hypochondriaca
NVHTLR

SEQ ID NO: 6193 - protein, 6 aa, Lysiphlebus testaceipes
LEIVGR

SEQ ID NO: 6194 - protein, 11 aa, Bemisia tabaci
FQEKPDWEYGI

SEQ ID NO: 6195 - protein, 10 aa, Bemisia tabaci
WQANPSSPGS

SEQ ID NO: 6196 - protein, 14 aa, Bemisia tabaci
LQYVEPGLHATPGT

SEQ ID NO: 6197 - protein, 12 aa, Bemisia tabaci
LQHEQPGGTPGH

SEQ ID NO: 6198 - protein, 10 aa, Bradysia hygida
YRERNWKDGD

SEQ ID NO: 6199 - protein, 13 aa, Solanum lycopersicum
KEKTDQYGLTYRT

SEQ ID NO: 6200 - protein, 6 aa, Solanum lycopersicum
WRFAGT

SEQ ID NO: 6201 - protein, 6 aa, Solanum tuberosum
WNSART

SEQ ID NO: 6202 - protein, 13 aa, Solanum tuberosum
KLKKSSSGFTYSE

SEQ ID NO: 6203 - protein, 13 aa, Solanum tuberosum
KLKKSPSGGTYSE

SEQ ID NO: 6204 - protein, 13 aa, Solanum tuberosum
KLKKSPSGFTYSE

SEQ ID NO: 6205 - protein, 13 aa, Solanum tuberosum
KLKKSPGGGTYSE

SEQ ID NO: 6206 - protein, 13 aa, Solanum tuberosum
KLKKSSSGFTYSE

SEQ ID NO: 6207 - protein, 13 aa, Solanum tuberosum
KLKKSSSGFTYSE

SEQ ID NO: 6208 - protein, 13 aa, Solanum tuberosum
KLKKSPSGGTYSE

SEQ ID NO: 6209 - protein, 14 aa, Solanum brevidens
KVKTNPYDGSASRT

SEQ ID NO: 6210 - protein, 6 aa, Solanum tuberosum
WNSART

SEQ ID NO: 6211 - protein, 11 aa, Hyoscyamus niger
VPSAFEGWRSQ

SEQ ID NO: 6212 - protein, 6 aa, Musca domestica
HNYAKK

SEQ ID NO: 6213 - protein, 6 aa, Aedes aegypti
LSFSYK

SEQ ID NO: 6214 - protein, 6 aa, Aedes aegypti
LSFSYK

SEQ ID NO: 6215 - protein, 6 aa, Anopheles gambiae
LSFSYK

SEQ ID NO: 6216 - protein, 10 aa, Mesembryanthemum crystallinum
YRQVGWARGY

SEQ ID NO: 6217 - protein, 10 aa, Mirabilis jalapa
LRQPGQGYGY

SEQ ID NO: 6218 - protein, 10 aa, Mirabilis jalapa
LRQPNQGYGV

SEQ ID NO: 6219 - protein, 10 aa, Phytolacca Americana
FQIAGQSYGV

SEQ ID NO: 6220 - protein, 10 aa, Phytolacca Americana
FQIAGQSYGV

SEQ ID NO: 6221 - protein, 10 aa, Phytolacca Americana
LQIAGQSYGV

SEQ ID NO: 6222 - protein, 6 aa, Petunia hybrid
SKILRR

SEQ ID NO: 6223 - protein, 6 aa, Petunia hybrid
SKILRR

SEQ ID NO: 6224 - protein, 9 aa, Pisum sativum
IPVGLVVGY

SEQ ID NO: 6225 - protein, 9 aa, Pisum sativum
IPVGLVVGY

SEQ ID NO: 6226 - protein, 9 aa, Pisum sativum
IPAGLVIGN

SEQ ID NO: 6227 - protein, 9 aa, Pisum sativum
IPVGLFIGY

SEQ ID NO: 6228 - protein, 9 aa, Pisum sativum
IPVGLLIGY

SEQ ID NO: 6229 - protein, 9 aa, Pisum sativum
IPVGLVIGY

SEQ ID NO: 6230 - protein, 9 aa, Glycine soja
VPIGLFVGF

SEQ ID NO: 6231 - protein, 10 aa, Phaseolus angularis
IPAGLLFVGY

SEQ ID NO: 6232 - protein, 9 aa, Phaseolus angularis
IPIALFGGF

SEQ ID NO: 6233 - protein, 9 aa, Glycine max
VPIGLFVGF

SEQ ID NO: 6234 - protein, 11 aa, Medicago truncatula
VSQGYPYDGGI

SEQ ID NO: 6235 - protein, 9 aa, Medicago truncatula
VHLHLVGST

SEQ ID NO: 6236 - protein, 11 aa, Medicago truncatula
VSEWSHYDGGI

SEQ ID NO: 6237 - protein, 9 aa, Vicia hirsute
IPVGLVVGY

SEQ ID NO: 6238 - protein, 9 aa, Trigonella foenum-graecum
IPIVLVGGY

SEQ ID NO: 6239 - protein, 9 aa, Onobrychis viciifolia
VPWGLFVGQ

SEQ ID NO: 6240 - protein, 9 aa, Mundulea sericea
IPVVLVGGY

SEQ ID NO: 6241 - protein, 9 aa, Melilotus alba
IPVVLLGGN

SEQ ID NO: 6242 - protein, 9 aa, Philenoptera violacea
IPWGLVVGQ

SEQ ID NO: 6243 - protein, 9 aa, Canavalia brasiliensis
IPWGLVAGY

SEQ ID NO: 6244 - protein, 9 aa, Bituminaria bituminosa
VPWGLFVGQ

SEQ ID NO: 6245 - protein, 9 aa, Bituminaria bituminosa
IPIVLLAGF

SEQ ID NO: 6246 - protein, 9 aa, Bituminaria bituminosa
IPWGLFVGE

SEQ ID NO: 6247 - protein, 9 aa, Phaseolus vulgaris
IPYGLFIGA

SEQ ID NO: 6248 - protein, 9 aa, Glycine max
VPIGLVAGF

SEQ ID NO: 6249 - protein, 9 aa, Medicago truncatula
IPIGLVAGY

SEQ ID NO: 6250 - protein, 4 aa, Mesobuthus martensii
FGPQ

SEQ ID NO: 6251 - protein, 4 aa, Mesobuthus martensii
FGPQ

SEQ ID NO: 6252 - protein, 4 aa, Mesobuthus tamulus
KGPQ

SEQ ID NO: 6253 - protein, 4 aa, Mesobuthus eupeus
FGPQ

SEQ ID NO: 6254 - protein, 4 aa, Buthus sindicus
YGPQ

SEQ ID NO: 6255 - protein, 4 aa, Leiurus quinquestratus hebraeus
YGPQ

SEQ ID NO: 6256 - protein, 3 aa, Mesobuthus eupeus
FGQ

SEQ ID NO: 6257 - protein, 4 aa, Mesobuthus tamulus
ASYQ

SEQ ID NO: 6258 - protein, 4 aa, Mesobuthus eupeus
FGPQ

SEQ ID NO: 6259 - protein, 4 aa, Mesobuthus eupeus
FGPQ

SEQ ID NO: 6260 - protein, 4 aa, Leiurus quinquestratus hebraeus
YGPQ

SEQ ID NO: 6261 - protein, 4 aa, Buthus sindicus
FGPQ

SEQ ID NO: 6262 - protein, 4 aa, Leiurus quinquestratus quinquestratus
YGPQ

SEQ ID NO: 6263 - protein, 4 aa, Mesobuthus eupeus
VGPQ

SEQ ID NO: 6264 - protein, 4 aa, Mesobuthus eupeus
FGPQ

SEQ ID NO: 6265 - protein, 10 aa, Pandinus imperator
KRRGTNAEKR

SEQ ID NO: 6266 - protein, 10 aa, Opistophthalmus carinatus
KRRGTNPEKR

SEQ ID NO: 6267 - protein, 10 aa, Opistophthalmus carinatus
KRRGANPEKR

SEQ ID NO: 6268 - protein, 8 aa, Mesobuthus martensii
ISTGVNYY

SEQ ID NO: 6269 - protein, 10 aa, Scorpio maurus palmatus
KRRGTNIEKR

SEQ ID NO: 6270 - protein, 4 aa, Centruroides noxius
MFFK

SEQ ID NO: 6271 - protein, 4 aa, Centruroides elegans
MFFK

SEQ ID NO: 6272 - protein, 4 aa, Centruroides gracilis
MFFK

SEQ ID NO: 6273 - protein, 4 aa, Centruroides sculpturatus
MFFK

SEQ ID NO: 6274 - protein, 4 aa, Centruroides limpidus limpidus
MFFK

SEQ ID NO: 6275 - protein, 4 aa, Centruroides exilicauda
MFFK

SEQ ID NO: 6276 - protein, 4 aa, Centruroides noxius
DFFK

SEQ ID NO: 6277 - protein, 4 aa, Centruroides elegans
EFFK

SEQ ID NO: 6278 - protein, 4 aa, Centruroides sculpturatus
DFFK

SEQ ID NO: 6279 - protein, 4 aa, Centruroides gracilis
DFFK

SEQ ID NO: 6280 - protein, 4 aa, Centruroides limpidus limpidus
VYFK

SEQ ID NO: 6281 - protein, 4 aa, Centruroides noxius
VYYK

SEQ ID NO: 6282 - protein, 4 aa, Centruroides exilicauda
EYYK

SEQ ID NO: 6283 - protein, 4 aa, Centruroides exilicauda
EYFK

SEQ ID NO: 6284 - protein, 4 aa, Centruroides exilicauda
EYFK

SEQ ID NO: 6285 - protein, 4 aa, Centruroides limpidus limpidus
VYFK

SEQ ID NO: 6286 - protein, 4 aa, Centruroides limpidus limpidus
VYLK

SEQ ID NO: 6287 - protein, 4 aa, Centruroides elegans
VYYK

SEQ ID NO: 6288 - protein, 4 aa, Centruroides sculpturatus
VYYK

SEQ ID NO: 6289 - protein, 4 aa, Centruroides sculpturatus
VYYK

SEQ ID NO: 6290 - protein, 4 aa, Centruroides sculpturatus
VYYK

SEQ ID NO: 6291 - protein, 4 aa, Centruroides sculpturatus
VYYK

SEQ ID NO: 6292 - protein, 4 aa, Centruroides sculpturatus
VYYK

SEQ ID NO: 6293 - protein, 4 aa, Centruroides sculpturatus
MFFK

SEQ ID NO: 6294 - protein, 4 aa, Centruroides gracilis
IYFK

SEQ ID NO: 6295 - protein, 4 aa, Momordica charantia
VDGH

SEQ ID NO: 6296 - protein, 4 aa, Momordica charantia
VDGH

SEQ ID NO: 6297 - protein, 5 aa, Lagenaria siceraria
LEHGI

SEQ ID NO: 6298 - protein, 5 aa, Citrullus lanatus
LQHGI

SEQ ID NO: 6299 - protein, 5 aa, Cucurbita maxima
LEHGY

SEQ ID NO: 6300 - protein, 5 aa, Luffa cylindrical
LEQGF

SEQ ID NO: 6301 - protein, 5 aa, Momordica charantia
MAHGF

SEQ ID NO: 6302 - protein, 5 aa, Momordica cochinchinensis
RGNGY

SEQ ID NO: 6303 - protein, 5 aa, Momordica repens
KRQGY

SEQ ID NO: 6304 - protein, 5 aa, Momordica repens
LSNGY

SEQ ID NO: 6305 - protein, 6 aa, Trichosanthes kirilowii
LEDIGY

SEQ ID NO: 6306 - protein, 5 aa, Cucumis sativus
QKNGY

SEQ ID NO: 6307 - protein, 5 aa, Bryonia dioica
GPNGF

SEQ ID NO: 6308 - protein, 6 aa, Ecballium elaterium
LEQDGF

SEQ ID NO: 6309 - protein, 4 aa, Luffa cylindrical
VDGH

SEQ ID NO: 6310 - protein, 5 aa, Momordocia charantia
RGNGY

SEQ ID NO: 6311 - protein, 5 aa, Momordocia cochinchinensis
QESGY

SEQ ID NO: 6312 - protein, 5 aa, Sechium edule
LKEGF

SEQ ID NO: 6313 - protein, 5 aa, Cucumis melo
LEHGY

SEQ ID NO: 6314 - protein, 5 aa, Cucurbita pepo
EESGF

SEQ ID NO: 6315 - protein, 5 aa, Cyclanthera pedata
LENGF

SEQ ID NO: 6316 - protein, 5 aa, Luffa cylindrical
MAHGF

SEQ ID NO: 6317 - protein, 5 aa, Momordica charantia
KENGY

SEQ ID NO: 6318 - protein, 5 aa, Momordica cochinchinensis
LEHGY

SEQ ID NO: 6319 - protein, 6 aa, Cucurbita maxima
LEHIEY

SEQ ID NO: 6320 - protein, 5 aa, Cucumis sativus
QENGF

SEQ ID NO: 6321 - protein, 5 aa, Luffa cylindrical
LENGF

SEQ ID NO: 6322 - protein, 5 aa, Cyclanthera pedata
QESGF

SEQ ID NO: 6323 - protein, 5 aa, Luffa cylindrical
LSNGY

SEQ ID NO: 6324 - protein, 5 aa, Sechium edule
RPSGF

SEQ ID NO: 6325 - protein, 5 aa, Cyclanthera pedata
EEHGF

SEQ ID NO: 6326 - protein, 5 aa, Cyclanthera pedata
QEHGF

SEQ ID NO: 6327 - protein, 4 aa, Momordica charantia
VAGH

SEQ ID NO: 6328 - protein, 5 aa, Cucumis melo
KRNGY

SEQ ID NO: 6329 - protein, 5 aa, Cucumis melo
LKEGF

SEQ ID NO: 6330 - protein, 5 aa, Cucumis melo
LKEGF

SEQ ID NO: 6331 - protein, 10 aa, Mirabilis jalapa
VPHPRLRIFV

SEQ ID NO: 6332 - protein, 10 aa, Spinacia oleracea
VPHPILRIFV

SEQ ID NO: 6333 - protein, 10 aa, Spinacia oleracea
VPHPILRIFV

SEQ ID NO: 6334 - protein, 10 aa, Spinacia oleracea
VPHPILRIFV

SEQ ID NO: 6335 - protein, 9 aa, Ancylometes
EMRYGAGKR

SEQ ID NO: 6336 - protein, 13 aa, Atrax robustus
TYKENENGNTVQR

SEQ ID NO: 6337 - protein, 13 aa, Atrax robustus
QEQLNENGHTVKR

SEQ ID NO: 6338 - protein, 13 aa, Atrax robustus
TFKENENGNTVKR

SEQ ID NO: 6339 - protein, 13 aa, Atrax robustus
TYKENENGNTVQR

SEQ ID NO: 6340 - protein, 13 aa, Atrax robustus
TFKENETGNTVKR

SEQ ID NO: 6341 - protein, 19 aa, Lycosa kazakhstanicus
VCWSQTVSRNSSRKEKKCQ

SEQ ID NO: 6342 - protein, 19 aa, Lycosa kazakhstanicus
VCWSQTVSRNSSRKEKKCQ

SEQ ID NO: 6343 - protein, 19 aa, Lycosa kazakhstanicus
VCWSQTVSRNSSGKEKKCQ

SEQ ID NO: 6344 - protein, 19 aa, Lycosa kazakhstanicus
VCWSQTVPRNSSRKEKKCQ

SEQ ID NO: 6345 - protein, 19 aa, Lycosa kazakhstanicus
VCWSQTVSRNSSRKEKKCQ

SEQ ID NO: 6346 - protein, 19 aa, Lycosa kazakhstanicus
VCWSQTVSRNSSRKEKKCQ

SEQ ID NO: 6347 - protein, 19 aa, Lycosa kazakhstanicus
VCWSQTVSRNSSRKEKKCQ

SEQ ID NO: 6348 - protein, 3 aa, Grammostola rosea
RLW

SEQ ID NO: 6349 - protein, 3 aa, Grammostola rosea
RLW

SEQ ID NO: 6350 - protein, 6 aa, Chilobrachys juingzhao
KPTLKY

SEQ ID NO: 6351 - protein, 6 aa, Chilobrachys juingzhao
SKTWGW

SEQ ID NO: 6352 - protein, 7 aa, Chilobrachys juingzhao
RWEKPSW

SEQ ID NO: 6353 - protein, 6 aa, Chilobrachys juingzhao
SPTWKW

SEQ ID NO: 6354 - protein, 6 aa, Chilobrachys juingzhao
SPTWKW

SEQ ID NO: 6355 - protein, 9 aa, Chilobrachys juingzhao
KGPSPKQKK

SEQ ID NO: 6356 - protein, 9 aa, Chilobrachys juingzhao
KGPSPKQKK

SEQ ID NO: 6357 - protein, 9 aa, Chilobrachys juingzhao
KGPSPKQKK

SEQ ID NO: 6358 - protein, 9 aa, Chilobrachys juingzhao
KGPSPNTKK

SEQ ID NO: 6359 - protein, 4 aa, Chilobrachys juingzhao
VRGK

SEQ ID NO: 6360 - protein, 3 aa, Chilobrachys juingzhao
ELW

SEQ ID NO: 6361 - protein, 3 aa, Chilobrachys juingzhao
ELW

SEQ ID NO: 6362 - protein, 6 aa, Chilobrachys juingzhao
KIGLYL

SEQ ID NO: 6363 - protein, 6 aa, Chilobrachys juingzhao
KIGLYL

SEQ ID NO: 6364 - protein, 6 aa, Chilobrachys juingzhao
QPAIKW

SEQ ID NO: 6365 - protein, 6 aa, Chilobrachys juingzhao
TWPTEI

SEQ ID NO: 6366 - protein, 6 aa, Chilobrachys juingzhao
TWPTEI

SEQ ID NO: 6367 - protein, 6 aa, Chilobrachys juingzhao
SPTWKW

SEQ ID NO: 6368 - protein, 6 aa, Chilobrachys juingzhao
SPTWKW

SEQ ID NO: 6369 - protein, 6 aa, Chilobrachys juingzhao
SPTWKW

SEQ ID NO: 6370 - protein, 6 aa, Chilobrachys juingzhao
SPTWKW

SEQ ID NO: 6371 - protein, 6 aa, Chilobrachys juingzhao
SPTWKW

SEQ ID NO: 6372 - protein, 6 aa, Chilobrachys juingzhao
SPTWKW

SEQ ID NO: 6373 - protein, 6 aa, Chilobrachys juingzhao
SPTWKW

SEQ ID NO: 6374 - protein, 6 aa, Chilobrachys juingzhao
GSQWKW

SEQ ID NO: 6375 - protein, 6 aa, Chilobrachys juingzhao
GSQWKW

SEQ ID NO: 6376 - protein, 6 aa, Chilobrachys juingzhao
GRQWKW

SEQ ID NO: 6377 - protein, 6 aa, Chilobrachys juingzhao
SPRWGW

SEQ ID NO: 6378 - protein, 6 aa, Chilobrachys juingzhao
SPKWGL

SEQ ID NO: 6379 - protein, 6 aa, Chilobrachys juingzhao
SPKWGL

SEQ ID NO: 6380 - protein, 6 aa, Chilobrachys juingzhao
KRTFNY

SEQ ID NO: 6381 - protein, 6 aa, Chilobrachys juingzhao
KRTFNY

SEQ ID NO: 6382 - protein, 6 aa, Chilobrachys juingzhao
KPTLKY

SEQ ID NO: 6383 - protein, 6 aa, Chilobrachys juingzhao
KPTLKY

SEQ ID NO: 6384 - protein, 6 aa, Chilobrachys juingzhao
KPTLKY

SEQ ID NO: 6385 - protein, 6 aa, Chilobrachys juingzhao
KPTLKY

SEQ ID NO: 6386 - protein, 6 aa, Chilobrachys juingzhao
KPTLKY

SEQ ID NO: 6387 - protein, 6 aa, Chilobrachys juingzhao
KPTLKY

SEQ ID NO: 6388 - protein, 5 aa, Chilobrachys juingzhao
TRFNV

SEQ ID NO: 6389 - protein, 5 aa, Chilobrachys juingzhao
TRFNV

SEQ ID NO: 6390 - protein, 5 aa, Chilobrachys juingzhao
TRFNV

SEQ ID NO: 6391 - protein, 5 aa, Chilobrachys juingzhao
TRFNV

SEQ ID NO: 6392 - protein, 5 aa, Chilobrachys juingzhao
SQHRL

SEQ ID NO: 6393 - protein, 6 aa, Chilobrachys juingzhao
DRRDQW

SEQ ID NO: 6394 - protein, 6 aa, Chilobrachys juingzhao
NRRDKW

SEQ ID NO: 6395 - protein, 6 aa, Chilobrachys juingzhao
KDVLYY

SEQ ID NO: 6396 - protein, 6 aa, Chilobrachys juingzhao
KDVLYY

SEQ ID NO: 6397 - protein, 7 aa, Chilobrachys juingzhao
RKKWPYH

SEQ ID NO: 6398 - protein, 7 aa, Chilobrachys juingzhao
RTKWPYH

SEQ ID NO: 6399 - protein, 7 aa, Chilobrachys juingzhao
RKKWPYH

SEQ ID NO: 6400 - protein, 7 aa, Chilobrachys juingzhao
RRTLPTY

SEQ ID NO: 6401 - protein, 7 aa, Chilobrachys juingzhao
RRTLPTY

SEQ ID NO: 6402 - protein, 7 aa, Chilobrachys juingzhao
RRAKPSW

SEQ ID NO: 6403 - protein, 7 aa, Chilobrachys juingzhao
RRAKPSW

SEQ ID NO: 6404 - protein, 7 aa, Chilobrachys juingzhao
RRAKPSW

SEQ ID NO: 6405 - protein, 7 aa, Chilobrachys juingzhao
RRAKPSW

SEQ ID NO: 6406 - protein, 7 aa, Chilobrachys juingzhao
RRTKPSW

SEQ ID NO: 6407 - protein, 7 aa, Chilobrachys juingzhao
RWEKPSW

SEQ ID NO: 6408 - protein, 7 aa, Chilobrachys juingzhao
RWEKPSW

SEQ ID NO: 6409 - protein, 6 aa, Chilobrachys juingzhao
HSRWDW

SEQ ID NO: 6410 - protein, 5 aa, Chilobrachys juingzhao
TKFRR

SEQ ID NO: 6411 - protein, 5 aa, Chilobrachys juingzhao
TKFRR

SEQ ID NO: 6412 - protein, 6 aa, Chilobrachys juingzhao
KPTLKY

SEQ ID NO: 6413 - protein, 6 aa, Chilobrachys juingzhao
ERSSPW

SEQ ID NO: 6414 - protein, 9 aa, Chilobrachys juingzhao
ICPYIGDCI

SEQ ID NO: 6415 - protein, 9 aa, Chilobrachys juingzhao
ICPYIGDCI

SEQ ID NO: 6416 - protein, 9 aa, Chilobrachys juingzhao
ICPYIGDCI

SEQ ID NO: 6417 - protein, 14 aa, Chilobrachys juingzhao
EKTFGYGWWYGSPF

SEQ ID NO: 6418 - protein, 14 aa, Chilobrachys juingzhao
EKTFGYGWWYGSPF

SEQ ID NO: 6419 - protein, 4 aa, Chilobrachys juingzhao
RYGS

SEQ ID NO: 6420 - protein, 7 aa, Chilobrachys juingzhao
KRKWPNI

SEQ ID NO: 6421 - protein, 9 aa, Chilobrachys juingzhao
QLGYGCSRV

SEQ ID NO: 6422 - protein, 16 aa, Calisoga sp
GTFWTCYIRKDPCSKE

SEQ ID NO: 6423 - protein, 16 aa, Calisoga sp
GTFWTCFIRKDPCSKE

SEQ ID NO: 6424 - protein, 16 aa, Calisoga sp
GIFWTCYLRKDPCSKE

SEQ ID NO: 6425 - protein, 8 aa, Ctenus ornatus
KTAFIGRI

SEQ ID NO: 6426 - protein, 6 aa, Chilobrachys juingzhao
KPTLKY

SEQ ID NO: 6427 - protein, 3 aa, Chilobrachys juingzhao
ELW

SEQ ID NO: 6428 - protein, 6 aa, Chilobrachys juingzhao
KIGLYL

SEQ ID NO: 6429 - protein, 6 aa, Chilobrachys juingzhao
SKTWGW

SEQ ID NO: 6430 - protein, 3 aa, Chilobrachys juingzhao
KLW

SEQ ID NO: 6431 - protein, 6 aa, Chilobrachys juingzhao
SPTWKW

SEQ ID NO: 6432 - protein, 3 aa, Grammostoal rosea
RLW

SEQ ID NO: 6433 - protein, 6 aa, Grammostoal rosea
SKLFKL

SEQ ID NO: 6434 - protein, 8 aa, Agelena orientalis
KCKGSSCV

SEQ ID NO: 6435 - protein, 9 aa, Agelena orientalis
SCMQPPNCI

SEQ ID NO: 6436 - protein, 9 aa, Agelena orientalis
SCRQPPYCI

SEQ ID NO: 6437 - protein, 9 aa, Agelena orientalis
TCRYFPKCI

SEQ ID NO: 6438 - protein, 9 aa, Agelena orientalis
TCRYFPKCI

SEQ ID NO: 6439 - protein, 9 aa, Agelena orientalis
TCRYFPKCI

SEQ ID NO: 6440 - protein, 9 aa, Agelena orientalis
TCQYFPKCI

SEQ ID NO: 6441 - protein, 9 aa, Agelena orientalis
TCRYFPKCI

SEQ ID NO: 6442 - protein, 9 aa, Agelena orientalis
TCRYFPKCI

SEQ ID NO: 6443 - protein, 9 aa, Agelena orientalis
TCRYFPKCI

SEQ ID NO: 6444 - protein, 9 aa, Agelena orientalis
SCRSMPYCR

SEQ ID NO: 6445 - protein, 9 aa, Agelena orientalis
TCRYFPKCI

SEQ ID NO: 6446 - protein, 9 aa, Agelena orientalis
SCRSMPYCR

SEQ ID NO: 6447 - protein, 9 aa, Agelena orientalis
SCRSYPGCM

SEQ ID NO: 6448 - protein, 10 aa, Agelena orientalis
RYTGRAVPFM

SEQ ID NO: 6449 - protein, 9 aa, Agelena orientalis
KELSIWDSR

SEQ ID NO: 6450 - protein, 9 aa, Agelena orientalis
KELNIWANK

SEQ ID NO: 6451 - protein, 9 aa, Agelena orientalis
KELNIWDSR

SEQ ID NO: 6452 - protein, 9 aa, Agelena orientalis
KELNIWASK

SEQ ID NO: 6453 - protein, 9 aa, Agelena orientalis
KELNIWASK

SEQ ID NO: 6454 - protein, 9 aa, Agelena orientalis
KELNIWASK

SEQ ID NO: 6455 - protein, 9 aa, Agelena orientalis
KELTIWNTK

SEQ ID NO: 6456 - protein, 9 aa, Agelena orientalis
KELSIWDSI

SEQ ID NO: 6457 - protein, 9 aa, Agelena orientalis
KELSIWDSI

SEQ ID NO: 6458 - protein, 9 aa, Agelena orientalis
KELSIWDSR

SEQ ID NO: 6459 - protein, 9 aa, Agelena orientalis
KELSIRDSR

SEQ ID NO: 6460 - protein, 9 aa, Agelena orientalis
KELSIWDST

SEQ ID NO: 6461 - protein, 9 aa, Agelena orientalis
KELSIWDSR

SEQ ID NO: 6462 - protein, 9 aa, Agelena orientalis
KELSIWDST

SEQ ID NO: 6463 - protein, 9 aa, Agelena orientalis
KELSIWDSR

SEQ ID NO: 6464 - protein, 9 aa, Agelena orientalis
KELSIWASK

SEQ ID NO: 6465 - protein, 9 aa, Agelena orientalis
KELSIYDSR

SEQ ID NO: 6466 - protein, 9 aa, Agelena orientalis
KELSIWDSR

SEQ ID NO: 6467 - protein, 17 aa, Segestria florentina
SNGPIARPWEMMVGNCM

SEQ ID NO: 6468 - protein, 17 aa, Segestria florentina
LNGPYARPWEMLVGNCK

SEQ ID NO: 6469 - protein, 17 aa, Segestria florentina
LNGPIARPWEMMVGNCK

SEQ ID NO: 6470 - protein, 17 aa, Segestria florentina
LNGPIARPWKMMVGNCK

SEQ ID NO: 6471 - protein, 17 aa, Segestria florentina
PNGPLARPWEMLVGNCK

SEQ ID NO: 6472 - protein, 17 aa, Segestria florentina
LNGPIARPWEMMVGNCK

SEQ ID NO: 6473 - protein, 17 aa, Segestria florentina
PNGPLARPWEVLVGNCK

SEQ ID NO: 6474 - protein, 17 aa, Segestria florentina
PNGPLARPWEMLVGNCK

SEQ ID NO: 6475 - protein, 8 aa, Phoneutria nigriventer
RTAFLRMI

SEQ ID NO: 6476 - protein, 4 aa, Tachypleus tridentatus
KAFR

SEQ ID NO: 6477 - protein, 10 aa, Hadronyche formidabilis
KGPEPNGVSY

SEQ ID NO: 6478 - protein, 10 aa, Hadronyche versuta
QGPESNGVVY

SEQ ID NO: 6479 - protein, 10 aa, Hadronyche versuta
QGPEPNGVSY

SEQ ID NO: 6480 - protein, 9 aa, Hadronyche versuta
KAESNGVSY

SEQ ID NO: 6481 - protein, 10 aa, Agelenopsis aperta
ICSIMGTNCE

SEQ ID NO: 6482 - protein, 10 aa, Agelenopsis aperta
RCSMIGTNCE

SEQ ID NO: 6483 - protein, 7 aa, Missulena bradleyi
NGNTVYR

SEQ ID NO: 6484 - protein, 13 aa, Atrax robustus
TYKENENGNTVQR

SEQ ID NO: 6485 - protein, 13 aa, Hadronyche infensa
TYKANENGNQVKR

SEQ ID NO: 6486 - protein, 13 aa, Hadronyche versuta
TFKENENGNTVKR

SEQ ID NO: 6487 - protein, 13 aa, Hadronyche formidabilis
TFKTNENGNTVKR

SEQ ID NO: 6488 - protein, 13 aa, Hadronyche infensa
TYKANENGNQVKR

SEQ ID NO: 6489 - protein, 13 aa, Hdronyche versuta
TYKENENGNTVKR

SEQ ID NO: 6490 - protein, 13 aa, Hadronyche infensa
TYKANENGNQVKR

SEQ ID NO: 6491 - protein, 13 aa, Hadronyche versuta
TFKENENGNTVKR

SEQ ID NO: 6492 - protein, 13 aa, Hadronyche versuta
TYKENENGNTVQR

SEQ ID NO: 6493 - protein, 13 aa, Hadronyche versuta
TYKENENGNTVKR

SEQ ID NO: 6494 - protein, 13 aa, Hadronyche versuta
TYKTNENGNSVQR

SEQ ID NO: 6495 - protein, 4 aa, Atrax
KMGL

SEQ ID NO: 6496 - protein, 4 aa, Hadronyche infensa
TLGI

SEQ ID NO: 6497 - protein, 4 aa, Hadronyche versuta
KRGS

SEQ ID NO: 6498 - protein, 4 aa, Atrax
KMGL

SEQ ID NO: 6499 - protein, 4 aa, Hadronyche infensa
TLGI

SEQ ID NO: 6500 - protein, 14 aa, Cupiennius salei
TCFYPSQAKKELCT

SEQ ID NO: 6501 - protein, 8 aa, Phoneutria nigriventer
MTAFMGKI

SEQ ID NO: 6502 - protein, 8 aa, Phoneturia reidyi
INAFQGRI

SEQ ID NO: 6503 - protein, 8 aa, Phoneutria keyserlingi
MCSANRCN

SEQ ID NO: 6504 - protein, 19 aa, Lycosa kazakhstanicus
VCWSQTVSRNSSRKEKKCQ

SEQ ID NO: 6505 - protein, 6 aa, Certagyrus marshalli
SRRDRW

SEQ ID NO: 6506 - protein, 3 aa, Grammostola rosea
QLW

SEQ ID NO: 6507 - protein, 6 aa, Heteroscodra maculata
RSDWKY

SEQ ID NO: 6508 - protein, 6 aa, Psalmopoeus cambridgei
KMGLYY

SEQ ID NO: 6509 - protein, 6 aa, Stromatopelma calceatum griseipes
RSDGKY

SEQ ID NO: 6510 - protein, 6 aa, Stromatopelma calceatum
KPTSKY

SEQ ID NO: 6511 - protein, 6 aa, Theraphosa blondi
NRKHKW

SEQ ID NO: 6512 - protein, 8 aa, Phoneutria keyserlingi
RTAFMGKI

SEQ ID NO: 6513 - protein, 13 aa, Phoneutria keyserlingi
NCWYPTPDDQWCK

SEQ ID NO: 6514 - protein, 9 aa, Phoneutria nigriventer
FGFSIKDKM

SEQ ID NO: 6515 - protein, 8 aa, Phoneutria nigriventer
RTAFMGKI

SEQ ID NO: 6516 - protein, 11 aa, Phoneutria nigriventer
KSRIANMWPTF

SEQ ID NO: 6517 - protein, 11 aa, Phoneutria reidyi
KGRFVNTWPTF

SEQ ID NO: 6518 - protein, 8 aa, Phoneutria nigriventer
KTTGIVKL

SEQ ID NO: 6519 - protein, 6 aa, Ceratogyrus marshalli
SRRDRW

SEQ ID NO: 6520 - protein, 10 aa, Heteroscodra maculata
KEKWPITYKI

SEQ ID NO: 6521 - protein, 6 aa, Psalmopoeus cambridgei
KMGLDY

SEQ ID NO: 6522 - protein, 6 aa, Theraphosa blondi
RSRDQW

SEQ ID NO: 6523 - protein, 10 aa, Phoneutria nigriventer
KCNIVMDNCT

SEQ ID NO: 6524 - protein, 20 aa, Segestria florentina
NCRQIQHRHDYLGKRKYSCR

SEQ ID NO: 6525 - protein, 11 aa, Phoneutria keyserlingi
KSRVANMWPTF

SEQ ID NO: 6526 - protein, 10 aa, Phoneutria nigriventer
KCDLAMGNCI

SEQ ID NO: 6527 - protein, 8 aa, Phoneutria nigriventer
ICSGSNCK

SEQ ID NO: 6528 - protein, 13 aa, Phoneutria nigriventer
NCWYPTPGDQWCK

SEQ ID NO: 6529 - protein, 16 aa, Phoneutria nigriventer
SCWNKEGQPESDVWCE

SEQ ID NO: 6530 - protein, 10 aa, Phoneutria reidyi
KCDLAMGNCI

SEQ ID NO: 6531 - protein, 9 aa, Phoneutria nigriventer
QCTLGMTCK

SEQ ID NO: 6532 - protein, 6 aa, Ceratogyrus marshalli
NKKYWH

SEQ ID NO: 6533 - protein, 10 aa, Loxosceles intermedia
TCGPNCPSRG

SEQ ID NO: 6534 - protein, 6 aa, Paraphysa scrofa
SRKDKW

SEQ ID NO: 6535 - protein, 6 aa, Psalmopeoeus cambridgei
HSYWEW

SEQ ID NO: 6536 - protein, 6 aa, Theraphosa blondi
RVRDQW

SEQ ID NO: 6537 - protein, 6 aa, Hysterocrates gigas
HSLFSY

SEQ ID NO: 6538 - protein, 9 aa, Heteropoda venatoria
SKTGFVKNI

SEQ ID NO: 6539 - protein, 9 aa, Heteropoda venatoria
ATTGRFRYL

SEQ ID NO: 6540 - protein, 9 aa, Allagelena opulenta
KELSIWDSR

SEQ ID NO: 6541 - protein, 9 aa, Agelena orientalis
KELSIWDSR

SEQ ID NO: 6542 - protein, 17 aa, Cupiennius salei
QCSTFDDESGQPTERCA

SEQ ID NO: 6543 - protein, 9 aa, Hololena curta
NCSQPPYCL

SEQ ID NO: 6544 - protein, 9 aa, Hololena curta
SCRSMPYCR

SEQ ID NO: 6545 - protein, 9 aa, Hololena curta
SCRSMPYCR

SEQ ID NO: 6546 - protein, 8 aa, Phoneutria nigriventer
VREGSNRV

SEQ ID NO: 6547 - protein, 10 aa, Phoneutria reidyi
MCSMIGTNCT

SEQ ID NO: 6548 - protein, 17 aa, Cupiennius salei
KCFTVADAKGATSERCA

SEQ ID NO: 6549 - protein, 9 aa, Pireneitega luctuosa
SCRSMPYCR

SEQ ID NO: 6550 - protein, 9 aa, Pireneitega luctuosa
SCRSMPYCR

SEQ ID NO: 6551 - protein, 9 aa, Pireneitega luctuosa
SCPGFGKCR

SEQ ID NO: 6552 - protein, 9 aa, Pireneitega luctuosa
SCRSYPGCM

SEQ ID NO: 6553 - protein, 10 aa, Hadronyche versuta
VYAWYNEQGS

SEQ ID NO: 6554 - protein, 4 aa, Psalmopoeus cambridgei
RYGK

SEQ ID NO: 6555 - protein, 4 aa, Psalmopoeus cambridgei
SQNK

SEQ ID NO: 6556 - protein, 10 aa, Ctenus ornatus
QCSFGMTNCK

SEQ ID NO: 6557 - protein, 6 aa, Chilobrachys jingzhao
SPKWGL

SEQ ID NO: 6558 - protein, 6 aa, Chilobrachys jingzhao
SPKWGL

SEQ ID NO: 6559 - protein, 6 aa, Chilobrachys jingzhao
KPTLKY

SEQ ID NO: 6560 - protein, 4 aa, Haplopelma schmidti
SHNK

SEQ ID NO: 6561 - protein, 6 aa, Haplopelma schmidti
SDKHKW

SEQ ID NO: 6562 - protein, 6 aa, Haplopelma schmidti
SSRWKW

SEQ ID NO: 6563 - protein, 6 aa, Haplopelma schmidti
SRKTRW

SEQ ID NO: 6564 - protein, 6 aa, Haplopelma schmidti
HSNYEW

SEQ ID NO: 6565 - protein, 10 aa, Haplopelma schmidti
SGAKLGLAGS

SEQ ID NO: 6566 - protein, 6 aa, Haplopelma hainanum
NSRDKW

SEQ ID NO: 6567 - protein, 6 aa, Haplopelma hainanum
SSKHKW

SEQ ID NO: 6568 - protein, 6 aa, Haplopelma hainanum
SRKHRW

SEQ ID NO: 6569 - protein, 6 aa, Haplopelma hainanum
SRKHRW

SEQ ID NO: 6570 - protein, 6 aa, Grammostola rosea
KFRDKY

SEQ ID NO: 6571 - protein, 6 aa, Grammostola rosea
KFRDKY

SEQ ID NO: 6572 - protein, 4 aa, Heteropoda venatoria
SRQL

SEQ ID NO: 6573 - protein, 3 aa, Diguetia canities
RLW

SEQ ID NO: 6574 - protein, 3 aa, Diguetia canities
KLW

SEQ ID NO: 6575 - protein, 13 aa, Heteropoda venatoria
RCFTVEVFKKDCW

SEQ ID NO: 6576 - protein, 13 aa, Hapopelma schmidti
RCLKSGFFSSKCV

SEQ ID NO: 6577 - protein, 3 aa, Lasiodora
HLW

SEQ ID NO: 6578 - protein, 6 aa, Macrothele gigas
SRTWKW

SEQ ID NO: 6579 - protein, 14 aa, Macrothele gigas
LRPSGYGWWHGTYY

SEQ ID NO: 6580 - protein, 10 aa, Ctenus ornatus
SAGRFRKTKL

SEQ ID NO: 6581 - protein, 3 aa, Agelenopsis aperta
TGL

SEQ ID NO: 6582 - protein, 1 aa, Macrothele gigas
Q

SEQ ID NO: 6583 - protein, 9 aa, Agelenopsis aperta
SCRQPPKCI

SEQ ID NO: 6584 - protein, 13 aa, ;PRT1;Macrothele gigas
VKTSGYWWYKKTY

SEQ ID NO: 6585 - protein, 9 aa, Agelenopsis aperta
SCRSYPGCM

SEQ ID NO: 6586 - protein, 13 aa, Macrothele gigas
VETSGYWWYKRKY

SEQ ID NO: 6587 - protein, 9 aa, Agelenopsis aperta
SCRSMPYCR

SEQ ID NO: 6588 - protein, 9 aa, Agelenopsis aperta
TCRYFPKCI

SEQ ID NO: 6589 - protein, 9 aa, Agelenopsis aperta
TCRYFPKCI

SEQ ID NO: 6590 - protein, 4 aa, ;PRT1;Macrothele gigas
ALGI

SEQ ID NO: 6591 - protein, 9 aa, Agelenopsis aperta
TCRYFPKCI

SEQ ID NO: 6592 - protein, 9 aa, ;PRT1;Macrothele gigas
QCIFFVPCY

SEQ ID NO: 6593 - protein, 10 aa, ;PRT1;Macrothele gigas
APGLLGLVGH

SEQ ID NO: 6594 - protein, 7 aa, ;PRT1;Macrothele gigas
ESDLTGL

SEQ ID NO: 6595 - protein, 10 aa, ;PRT1;Macrothele gigas
VVTYHYADGV

SEQ ID NO: 6596 - protein, 3 aa, Paraphysa scrofa
RLW

SEQ ID NO: 6597 - protein, 9 aa, Psalmopoeus cambridgei
WKRRRSFEV

SEQ ID NO: 6598 - protein, 3 aa, Paraphysa scrofa
RLW

SEQ ID NO: 6599 - protein, 15 aa, Apomastus schlingeri
AYNVWNCIGGGCSKT

SEQ ID NO: 6600 - protein, 6 aa, Brachypelma smithi
SSRWKW

SEQ ID NO: 6601 - protein, 4 aa, Apomastus schlingeri
DGSE

SEQ ID NO: 6602 - protein, 6 aa, Thrixopelma pruriens
SRRHGW

SEQ ID NO: 6603 - protein, 3 aa, Thrixopelma pruriens
RLW

SEQ ID NO: 6604 - protein, 13 aa, Macrothele gigas
VKTSGRWWYKKTY

SEQ ID NO: 6605 - protein, 4 aa, Macrothele raveni
ALGI

SEQ ID NO: 6606 - protein, 3 aa, Heteropoda venatoria
RLW

SEQ ID NO: 6607 - protein, 6 aa, Coremiocnemis valida
KAYVVT

SEQ ID NO: 6608 - protein, 6 aa, Grammostola rosea
SSRWKW

SEQ ID NO: 6609 - protein, 3 aa, Grammostola rosea
RLW

SEQ ID NO: 6610 - protein, 6 aa, Grammostola rosea
NRRDKW

SEQ ID NO: 6611 - protein, 8 aa, Grammostola rosea
KSKWPRNI

SEQ ID NO: 6612 - protein, 9 aa, Asteropus simplex
IPLNDFVGI

SEQ ID NO: 6613 - protein, 10 aa, Terebra sublata
RYDPWSRELK

SEQ ID NO: 6614 - protein, 7 aa, Hyposoter fugitivus ichnovirus
FRFGKGI

SEQ ID NO: 6615 - protein, 7 aa, Hyposoter fugitivus ichnovirus
FRFGIGK

SEQ ID NO: 6616 - protein, 7 aa, Hyposoter fugitivus ichnovirus
FIFGQGL

SEQ ID NO: 6617 - protein, 7 aa, Hyposoter fugitivus ichnovirus
FVFGQGL

SEQ ID NO: 6618 - protein, 7 aa, Hyposoter fugitivus ichnovirus
FIFGQGL

SEQ ID NO: 6619 - protein, 7 aa, Campoletis sonorensis ichnovirus
FELGQGI

SEQ ID NO: 6620 - protein, 7 aa, Cotesia congregate bracovirus
DYLGKRV

SEQ ID NO: 6621 - protein, 7 aa, Cotesia congregate bracovirus
FKFGKGI

SEQ ID NO: 6622 - protein, 7 aa, Campoletis sonorensis ichnovirus
FKFGEGI

SEQ ID NO: 6623 - protein, 7 aa, Campoletis sonorensis ichnovirus
FKFGEGI

SEQ ID NO: 6624 - protein, 7 aa, Campoletis sonorensis ichnovirus
WRFGTGI

SEQ ID NO: 6625 - protein, 7 aa, Campoletis sonorensis ichnovirus
WRFGTGI

SEQ ID NO: 6626 - protein, 7 aa, Campoletis sonorensis ichnovirus
AVFGSGL

SEQ ID NO: 6627 - protein, 7 aa, Campoletis sonorensis ichnovirus
WRFGSGL

SEQ ID NO: 6628 - protein, 7 aa, Campoletis sonorensis ichnovirus
WRFGSGL

SEQ ID NO: 6629 - protein, 7 aa, Campoletis sonorensis ichnovirus
SVFDSGR

SEQ ID NO: 6630 - protein, 7 aa, Campoletis chlorideae ichnovirus
QRFLGGL

SEQ ID NO: 6631 - protein, 7 aa, Campoletis sonorensis ichnovirus
DRDGEGV

SEQ ID NO: 6632 - protein, 7 aa, Campoletis sp. Ichnovirus
SVFDSGV

SEQ ID NO: 6633 - protein, 7 aa, Campoletis sonorensis ichnovirus
DRFFGGL

SEQ ID NO: 6634 - protein, 6 aa, Ectoropis oblique NPV
SAAFGF

SEQ ID NO: 6635 - protein, 6 aa, Antheraea pernyi nuclear polyhedrosis virus
SALFKF

SEQ ID NO: 6636 - protein, 6 aa, Helicoverpa armigera granulovirus
SAVFKY

SEQ ID NO: 6637 - protein, 6 aa, Orgyia leucostigma NPV
SPVFNY

SEQ ID NO: 6638 - protein, 6 aa, Orgyia pseudotsugata multicapsid polyhedrosis virus
SAAFGF

SEQ ID NO: 6639 - protein, 6 aa, Autographa californica nuclear polyhedrosis virus
SPIFNY

SEQ ID NO: 6640 - protein, 6 aa, Anticarsia gemmatalis nuclear polyhedrosis virus
SAVFKY

SEQ ID NO: 6641 - protein, 6 aa, Plutella xylostella multiple nucleopolyhedrovirus
SPIFNY

SEQ ID NO: 6642 - protein, 6 aa, Antheraea pernyi nuclear polyhedrosis virus
SPVFNY

SEQ ID NO: 6643 - protein, 6 aa, Mamestra configurata NPV-B
SAAFGF

SEQ ID NO: 6644 - protein, 6 aa, Mamestra configurata NPV-A
SAAFGF

SEQ ID NO: 6645 - protein, 6 aa, Xestia c-nigrum granulosis virus
SAAFKY

SEQ ID NO: 6646 - protein, 4 aa, Hybanthus parviflorus
KNKV

SEQ ID NO: 6647 - protein, 4 aa, Chassalia parvifolia
KNKV

SEQ ID NO: 6648 - protein, 4 aa, Viola baoshanensis
KDKV

SEQ ID NO: 6649 - protein, 4 aa, Viola baoshanensis
KDKV

SEQ ID NO: 6650 - protein, 4 aa, Viola baoshanensis
KDKV

SEQ ID NO: 6651 - protein, 4 aa, Viola baoshanensis
SNNV

SEQ ID NO: 6652 - protein, 4 aa, Viola baoshanensis
SNRV

SEQ ID NO: 6653 - protein, 4 aa, Viola baoshanensis
KSKV

SEQ ID NO: 6654 - protein, 4 aa, Viola baoshanensis
KSKV

SEQ ID NO: 6655 - protein, 4 aa, Viola baoshanensis
SDKV

SEQ ID NO: 6656 - protein, 4 aa, Oldenlandia affinis
QDKV

SEQ ID NO: 6657 - protein, 4 aa, Oldenlandia affinis
KDQV

SEQ ID NO: 6658 - protein, 4 aa, Melicytus ramiflorus
QGKV

SEQ ID NO: 6659 - protein, 4 aa, Viola hederacea
SNKV

SEQ ID NO: 6660 - protein, 4 aa, Viola biflora
SNKV

SEQ ID NO: 6661 - protein, 4 aa, Viola odorata
SYPV

SEQ ID NO: 6662 - protein, 4 aa, Hybanthus floribundus E
KDKV

SEQ ID NO: 6663 - protein, 6 aa, Hybanthus floribundus E
NHHDKV

SEQ ID NO: 6664 - protein, 4 aa, Hybanthus floribundus E
KSKV

SEQ ID NO: 6665 - protein, 4 aa, Hybanthus floribundus E
RNKV

SEQ ID NO: 6666 - protein, 4 aa, Hybanthus floribundus E
KDKV

SEQ ID NO: 6667 - protein, 4 aa, Hybanthus floribundus E
KDKV

SEQ ID NO: 6668 - protein, 4 aa, Chassalia parvifolia
KNKV

SEQ ID NO: 6669 - protein, 4 aa, Chassalia parvifolia
KSKV

SEQ ID NO: 6670 - protein, 4 aa, Chassalia parvifolia
ENKV

SEQ ID NO: 6671 - protein, 4 aa, Chassalia parvifolia
ENKV

SEQ ID NO: 6672 - protein, 4 aa, Psychotria longipes
KSKV

SEQ ID NO: 6673 - protein, 4 aa, Viola baoshanensis
SSKV

SEQ ID NO: 6674 - protein, 4 aa, Viola baoshanensis
KSSV

SEQ ID NO: 6675 - protein, 4 aa, Viola baoshanensis
KSKV

SEQ ID NO: 6676 - protein, 4 aa, Viola baoshanensis
KNSR

SEQ ID NO: 6677 - protein, 4 aa, Viola baoshanensis
KNKV

SEQ ID NO: 6678 - protein, 4 aa, Viola baoshanensis
KSKV

SEQ ID NO: 6679 - protein, 4 aa, Viola baoshanensis
KSKV

SEQ ID NO: 6680 - protein, 6 aa, Viola baoshanensis
SLHTLE

SEQ ID NO: 6681 - protein, 4 aa, Viola baoshanensis
SSKV

SEQ ID NO: 6682 - protein, 4 aa, Viola baoshanensis
SSKV

SEQ ID NO: 6683 - protein, 4 aa, Viola baoshanensis
KSKV

SEQ ID NO: 6684 - protein, 4 aa, Viola baoshanensis
KSKV

SEQ ID NO: 6685 - protein, 4 aa, Viola baoshanensis
KSKV

SEQ ID NO: 6686 - protein, 4 aa, Viola baoshanensis
KNKV

SEQ ID NO: 6687 - protein, 4 aa, Viola baoshanensis
KSKV

SEQ ID NO: 6688 - protein, 4 aa, Viola baoshanensis
KSKV

SEQ ID NO: 6689 - protein, 4 aa, Viola baoshanensis
KSKV

SEQ ID NO: 6690 - protein, 4 aa, Viola baoshanensis
KSKV

SEQ ID NO: 6691 - protein, 4 aa, Viola baoshanensis
KNKV

SEQ ID NO: 6692 - protein, 4 aa, Viola baoshanensis
KNKV

SEQ ID NO: 6693 - protein, 4 aa, Viola baoshanensis
KSKV

SEQ ID NO: 6694 - protein, 4 aa, Viola baoshanensis
SSNV

SEQ ID NO: 6695 - protein, 4 aa, Leonia cymosa
TSSQ

SEQ ID NO: 6696 - protein, 4 aa, Leonia cymosa
KNKV

SEQ ID NO: 6697 - protein, 4 aa, Leonia cymosa
KNKV

SEQ ID NO: 6698 - protein, 4 aa, Hedyotis centranthoides
RNRS

SEQ ID NO: 6699 - protein, 4 aa, Hedyotis terminalis
TNGS

SEQ ID NO: 6700 - protein, 4 aa, Oldenlandia affinis
NYPI

SEQ ID NO: 6701 - protein, 4 aa, Oldenlandia affinis
SNQV

SEQ ID NO: 6702 - protein, 4 aa, Oldenlandia affinis
TDKV

SEQ ID NO: 6703 - protein, 4 aa, Melicytus ramiflorus
KSKV

SEQ ID NO: 6704 - protein, 4 aa, Melicytus ramiflorus
KSKV

SEQ ID NO: 6705 - protein, 4 aa, Melicytus ramiflorus
KNNV

SEQ ID NO: 6706 - protein, 4 aa, Viola hederacea
KNKV

SEQ ID NO: 6707 - protein, 4 aa, Viola biflora
KSKV

SEQ ID NO: 6708 - protein, 4 aa, Viola biflora
KSKV

SEQ ID NO: 6709 - protein, 4 aa, Viola tricolor
KSKV

SEQ ID NO: 6710 - protein, 4 aa, Hybathus floribundus E
KSKV

SEQ ID NO: 6711 - protein, 4 aa, Hybathus floribundus E
RNHV

SEQ ID NO: 6712 - protein, 4 aa, Hybathus floribundus E
KDNL

SEQ ID NO: 6713 - protein, 5 aa, Psychotria suterella
SVANI

SEQ ID NO: 6714 - protein, 4 aa, Chassalia parvifolia
KNKV

SEQ ID NO: 6715 - protein, 4 aa, Viola baoshanensis
KSKV

SEQ ID NO: 6716 - protein, 4 aa, Viola baoshanensis
SWPI

SEQ ID NO: 6717 - protein, 4 aa, Viola baoshanensis
SWPV

SEQ ID NO: 6718 - protein, 4 aa, Viola baoshanensis
SWPV

SEQ ID NO: 6719 - protein, 4 aa, Viola hederacea
RNRV

SEQ ID NO: 6720 - protein, 5 aa, Viola hederacea
DPWPV

SEQ ID NO: 6721 - protein, 4 aa, Viola odorata
KSKV

SEQ ID NO: 6722 - protein, 4 aa, Viola odorata
SWPV

SEQ ID NO: 6723 - protein, 4 aa, Viola odorata
SYPI

SEQ ID NO: 6724 - protein, 4 aa, Viola odorata
SYPI

SEQ ID NO: 6725 - protein, 4 aa, Viola odorata
KSKV

SEQ ID NO: 6726 - protein, 4 aa, Viola odorata
SWPV

SEQ ID NO: 6727 - protein, 4 aa, Viola odorata
SWPV

SEQ ID NO: 6728 - protein, 6 aa, Viola odorata
DSSWPI

SEQ ID NO: 6729 - protein, 5 aa, Viola odorata
DPWPV

SEQ ID NO: 6730 - protein, 4 aa, Viola odorata
KSKV

SEQ ID NO: 6731 - protein, 4 aa, Viola odorata
KSKV

SEQ ID NO: 6732 - protein, 4 aa, Leonia cymosa
KNKV

SEQ ID NO: 6733 - protein, 4 aa, Oldenlandia affinis
SWPV

SEQ ID NO: 6734 - protein, 5 aa, Oldenlandia affinis
SSWPI

SEQ ID NO: 6735 - protein, 5 aa, Oldenlandia affinis
SSWPI

SEQ ID NO: 6736 - protein, 4 aa, Oldenlandia affinis
TDPI

SEQ ID NO: 6737 - protein, 5 aa, Oldenlandia affinis
DPWPV

SEQ ID NO: 6738 - protein, 5 aa, Oldenlandia affinis
DPWPV

SEQ ID NO: 6739 - protein, 4 aa, Oldenlandia affinis
TWPI

SEQ ID NO: 6740 - protein, 4 aa, Oldenlandia affinis
TWPI

SEQ ID NO: 6741 - protein, 5 aa, Oldenlandia affinis
DPWPI

SEQ ID NO: 6742 - protein, 4 aa, Oldenlandia affinis
SWPV

SEQ ID NO: 6743 - protein, 5 aa, Oldenlandia affinis
SSWPI

SEQ ID NO: 6744 - protein, 4 aa, Oldenlandia affinis
SWPI

SEQ ID NO: 6745 - protein, 4 aa, Oldenlandia affinis
SWPV

SEQ ID NO: 6746 - protein, 4 aa, Melicytus ramiflorus
KSKV

SEQ ID NO: 6747 - protein, 4 aa, Melicytus ramiflorus
KNKV

SEQ ID NO: 6748 - protein, 4 aa, Melicytus ramiflorus
KRPV

SEQ ID NO: 6749 - protein, 4 aa, Melicytus ramiflorus
TWPV

SEQ ID NO: 6750 - protein, 4 aa, Melicytus ramiflorus
KSKV

SEQ ID NO: 6751 - protein, 4 aa, Melicytus ramiflorus
KNKV

SEQ ID NO: 6752 - protein, 4 aa, Melicytus ramiflorus
KSKV

SEQ ID NO: 6753 - protein, 4 aa, Melicytus ramiflorus
ESKV

SEQ ID NO: 6754 - protein, 4 aa, Melicytus ramiflorus
KSKV

SEQ ID NO: 6755 - protein, 4 aa, Viola odorata
SWPV

SEQ ID NO: 6756 - protein, 5 aa, Viola odorata
DPWPM

SEQ ID NO: 6757 - protein, 4 aa, Viola odorata
SWPV

SEQ ID NO: 6758 - protein, 4 aa, Viola odorata
SWPV

SEQ ID NO: 6759 - protein, 4 aa, Viola odorata
SWPV

SEQ ID NO: 6760 - protein, 4 aa, Viola odorata
SWPV

SEQ ID NO: 6761 - protein, 5 aa, Viola odorata
DPWPV

SEQ ID NO: 6762 - protein, 5 aa, Viola odorata
ETWPV

SEQ ID NO: 6763 - protein, 5 aa, Viola hederacea
DPWPV

SEQ ID NO: 6764 - protein, 4 aa, Viola biflora
SYPI

SEQ ID NO: 6765 - protein, 4 aa, Viola biflora
SYPI

SEQ ID NO: 6766 - protein, 4 aa, Viola biflora
SWPV

SEQ ID NO: 6767 - protein, 4 aa, Viola biflora
SYPI

SEQ ID NO: 6768 - protein, 4 aa, Viola biflora
KSKV

SEQ ID NO: 6769 - protein, 4 aa, Viola biflora
KSKV

SEQ ID NO: 6770 - protein, 4 aa, Viola biflora
KSKV

SEQ ID NO: 6771 - protein, 4 aa, Viola biflora
KSKV

SEQ ID NO: 6772 - protein, 4 aa, Viola cotyledon
KNKV

SEQ ID NO: 6773 - protein, 4 aa, Viola cotyledon
KNKV

SEQ ID NO: 6774 - protein, 4 aa, Viola arvensis
SRPV

SEQ ID NO: 6775 - protein, 4 aa, Viola odorata
SWPV

SEQ ID NO: 6776 - protein, 4 aa, Viola odorata
SWPV

SEQ ID NO: 6777 - protein, 6 aa, Chassalia discolor
DTIEKV

SEQ ID NO: 6778 - protein, 4 aa, Hybanthus floribundus E
TAFL

SEQ ID NO: 6779 - protein, 4 aa, Hybanthus floribundus E
TAFL

SEQ ID NO: 6780 - protein, 5 aa, Viola odorata
SKYPL

SEQ ID NO: 6781 - protein, 5 aa, Oldenlandia affinis
NKYRV

SEQ ID NO: 6782 - protein, 5 aa, Oldenlandia affinis
NTYRV

SEQ ID NO: 6783 - protein, 5 aa, Oldenlandia affinis
NTYRV

SEQ ID NO: 6784 - protein, 4 aa, Melcytus ramiflorus
SWPI

SEQ ID NO: 6785 - protein, 7 aa, Palicourea condensata
DDRSDGL

SEQ ID NO: 6786 - protein, 5 aa, Viola yedoensis
GNYGF

SEQ ID NO: 6787 - protein, 5 aa, Viola yedoensis
GNWGL

SEQ ID NO: 6788 - protein, 5 aa, Viola yedoensis
GNWGL

SEQ ID NO: 6789 - protein, 5 aa, Viola arvensis
GEWKL

SEQ ID NO: 6790 - protein, 5 aa, Viola arvensis
GEWKL

SEQ ID NO: 6791 - protein, 5 aa, Hybanthus parviflorus
YNGIP

SEQ ID NO: 6792 - protein, 5 aa, Chassalia parvifolia
YRAIP

SEQ ID NO: 6793 - protein, 5 aa, Viola baoshanensis
YNTIP

SEQ ID NO: 6794 - protein, 5 aa, Viola baoshanensis
YNGIP

SEQ ID NO: 6795 - protein, 5 aa, Viola baoshanensis
YNGIP

SEQ ID NO: 6796 - protein, 5 aa, Viola baoshanensis
YNGIP

SEQ ID NO: 6797 - protein, 5 aa, Viola baoshanensis
YNGIP

SEQ ID NO: 6798 - protein, 5 aa, Viola baoshanensis
YNGIP

SEQ ID NO: 6799 - protein, 5 aa, Viola baoshanensis
YNSIP

SEQ ID NO: 6800 - protein, 5 aa, Viola baoshanensis
YNGIP

SEQ ID NO: 6801 - protein, 5 aa, Oldenlandia affinis
YDGIP

SEQ ID NO: 6802 - protein, 5 aa, Oldenlandia affinis
YNGIP

SEQ ID NO: 6803 - protein, 5 aa, Melicytus ramiflorus
YHGIP

SEQ ID NO: 6804 - protein, 5 aa, Viola hederacea
YNGIP

SEQ ID NO: 6805 - protein, 5 aa, Viola biflora
YNGIP

SEQ ID NO: 6806 - protein, 5 aa, Viola odorata
KSAIS

SEQ ID NO: 6807 - protein, 6 aa, Hybanthus floribundus E
YLNSIS

SEQ ID NO: 6808 - protein, 6 aa, Hybanthus floribundus E
YWNSIS

SEQ ID NO: 6809 - protein, 6 aa, Hybanthus floribundus E
YRNGIP

SEQ ID NO: 6810 - protein, 6 aa, Hybanthus floribundus E
YFNGIA

SEQ ID NO: 6811 - protein, 6 aa, Hybanthus floribundus E
YLNGTP

SEQ ID NO: 6812 - protein, 6 aa, Hybanthus floribundus E
YLNGTP

SEQ ID NO: 6813 - protein, 6 aa, Chassalia parvifolia
YRNGIP

SEQ ID NO: 6814 - protein, 6 aa, Chassalia parvifolia
YRNGIP

SEQ ID NO: 6815 - protein, 6 aa, Chassalia parvifolia
YHDKIP

SEQ ID NO: 6816 - protein, 6 aa, Chassalia parvifolia
YHDKIP

SEQ ID NO: 6817 - protein, 6 aa, Psychotria longipes
YKNSIP

SEQ ID NO: 6818 - protein, 6 aa, Viola baoshanensis
YRNGIP

SEQ ID NO: 6819 - protein, 6 aa, Viola baoshanensis
YRNGVP

SEQ ID NO: 6820 - protein, 6 aa, Viola baoshanensis
YRNGIP

SEQ ID NO: 6821 - protein, 6 aa, Viola baoshanensis
QKNGAG

SEQ ID NO: 6822 - protein, 6 aa, Viola baoshanensis
YRKGIP

SEQ ID NO: 6823 - protein, 6 aa, Viola baoshanensis
YRNGIP

SEQ ID NO: 6824 - protein, 6 aa, Viola baoshanensis
YRNGIP

SEQ ID NO: 6825 - protein, 6 aa, Viola baoshanensis
VRNGRL

SEQ ID NO: 6826 - protein, 6 aa, Viola baoshanensis
YRNGIP

SEQ ID NO: 6827 - protein, 6 aa, Viola baoshanensis
YRNGIP

SEQ ID NO: 6828 - protein, 6 aa, Viola baoshanensis
YRNGIP

SEQ ID NO: 6829 - protein, 6 aa, Viola baoshanensis
YRNGIP

SEQ ID NO: 6830 - protein, 6 aa, Viola baoshanensis
YRNGIP

SEQ ID NO: 6831 - protein, 6 aa, Viola baoshanensis
YRNGIP

SEQ ID NO: 6832 - protein, 6 aa, Viola baoshanensis
YRNGIP

SEQ ID NO: 6833 - protein, 6 aa, Viola baoshanensis
YRDGIP

SEQ ID NO: 6834 - protein, 6 aa, Viola baoshanensis
YFNDIF

SEQ ID NO: 6835 - protein, 6 aa, Viola baoshanensis
YRNGIP

SEQ ID NO: 6836 - protein, 6 aa, Viola baoshanensis
YRNGIP

SEQ ID NO: 6837 - protein, 6 aa, Viola baoshanensis
YKNGTP

SEQ ID NO: 6838 - protein, 6 aa, Viola baoshanensis
YRNGIP

SEQ ID NO: 6839 - protein, 6 aa, Viola baoshanensis
YLNGVP

SEQ ID NO: 6840 - protein, 6 aa, Leonia cymosa
FKNGTA

SEQ ID NO: 6841 - protein, 6 aa, Leonia cymosa
YRNGIP

SEQ ID NO: 6842 - protein, 6 aa, Leonia cymosa
YRNGFP

SEQ ID NO: 6843 - protein, 6 aa, Hedyotis centranthoides
MRNGIP

SEQ ID NO: 6844 - protein, 6 aa, Hedyotis terminalis
MRNGIP

SEQ ID NO: 6845 - protein, 6 aa, Oldenlandia affinis
VKDGSL

SEQ ID NO: 6846 - protein, 6 aa, Oldenlandia affinis
YRNGVP

SEQ ID NO: 6847 - protein, 6 aa, Oldenlandia affinis
YLNGTP

SEQ ID NO: 6848 - protein, 6 aa, Melicytus ramiflorus
YRNGIP

SEQ ID NO: 6849 - protein, 6 aa, Melicytus ramiflorus
YRNGIP

SEQ ID NO: 6850 - protein, 6 aa, Melicytus ramiflorus
TLNGVP

SEQ ID NO: 6851 - protein, 6 aa, Viola hederacea
YLNSIS

SEQ ID NO: 6852 - protein, 6 aa, Viola biflora
YRNGIP

SEQ ID NO: 6853 - protein, 6 aa, Viola biflora
YRNGIP

SEQ ID NO: 6854 - protein, 6 aa, Viola tricolor
YRNGIP

SEQ ID NO: 6855 - protein, 7 aa, Hybathus floribundus E
YYNGSVP

SEQ ID NO: 6856 - protein, 7 aa, Hybathus floribundus E
YLNGEIP

SEQ ID NO: 6857 - protein, 7 aa, Hybathus floribundus E
YYNGNIP

SEQ ID NO: 6858 - protein, 7 aa, Psychotria suterella
VRNGFIP

SEQ ID NO: 6859 - protein, 7 aa, Chassalia parvifolia
YRNGVIP

SEQ ID NO: 6860 - protein, 7 aa, Viola baoshanensis
YRNGVIP

SEQ ID NO: 6861 - protein, 7 aa, Viola baoshanensis
TRNGLPI

SEQ ID NO: 6862 - protein, 7 aa, Viola baoshanensis
TRNGLPV

SEQ ID NO: 6863 - protein, 7 aa, Viola baoshanensis
TRNGLPV

SEQ ID NO: 6864 - protein, 7 aa, Viola hederacea
YLNSAIA

SEQ ID NO: 6865 - protein, 7 aa, Viola hederacea
TRNGLPV

SEQ ID NO: 6866 - protein, 7 aa, Viola odorata
YKNGTLP

SEQ ID NO: 6867 - protein, 7 aa, Viola odorata
TRNGLPI

SEQ ID NO: 6868 - protein, 7 aa, Viola odorata
KKNGLVP

SEQ ID NO: 6869 - protein, 7 aa, Viola odorata
KKINGLP

SEQ ID NO: 6870 - protein, 7 aa, Viola odorata
YKDGTLP

SEQ ID NO: 6871 - protein, 7 aa, Viola odorata
TRNGLPV

SEQ ID NO: 6872 - protein, 7 aa, Viola odorata
TRNGLPI

SEQ ID NO: 6873 - protein, 7 aa, Viola odorata
THNGLPT

SEQ ID NO: 6874 - protein, 7 aa, Viola odorata
THNGLPT

SEQ ID NO: 6875 - protein, 7 aa, Viola odorata
YKNGTLP

SEQ ID NO: 6876 - protein, 7 aa, Viola odorata
YKNGTLP

SEQ ID NO: 6877 - protein, 7 aa, Leonia cymosa
YRNGVIP

SEQ ID NO: 6878 - protein, 7 aa, Oldenlandia affinis
TRNGLPV

SEQ ID NO: 6879 - protein, 7 aa, Oldenlandia affinis
TRDGLPT

SEQ ID NO: 6880 - protein, 7 aa, Oldenlandia affinis
TRDGLPT

SEQ ID NO: 6881 - protein, 7 aa, Oldenlandia affinis
TRDGLPV

SEQ ID NO: 6882 - protein, 7 aa, Oldenlandia affinis
TRDGLPV

SEQ ID NO: 6883 - protein, 7 aa, Oldenlandia affinis
TRDGLPV

SEQ ID NO: 6884 - protein, 7 aa, Oldenlandia affinis
TRDGLPV

SEQ ID NO: 6885 - protein, 7 aa, Oldenlandia affinis
TRDGLPV

SEQ ID NO: 6886 - protein, 7 aa, Oldenlandia affinis
TRDGLPT

SEQ ID NO: 6887 - protein, 7 aa, Oldenlandia affinis
TRDGLPV

SEQ ID NO: 6888 - protein, 7 aa, Oldenlandia affinis
TRNGLPT

SEQ ID NO: 6889 - protein, 7 aa, Oldenlandia affinis
KRNGLPV

SEQ ID NO: 6890 - protein, 7 aa, Oldenlandia affinis
TRNGLPV

SEQ ID NO: 6891 - protein, 7 aa, Melicytus ramiflorus
YKNGSIP

SEQ ID NO: 6892 - protein, 7 aa, Melicytus ramiflorus
YRNGVIP

SEQ ID NO: 6893 - protein, 7 aa, Melicytus ramiflorus
YKNGHPT

SEQ ID NO: 6894 - protein, 7 aa, Melicytus ramiflorus
YRNGHPI

SEQ ID NO: 6895 - protein, 7 aa, Melicytus ramiflorus
YKNGSIP

SEQ ID NO: 6896 - protein, 7 aa, Melicytus ramiflorus
YKNGSIP

SEQ ID NO: 6897 - protein, 7 aa, Melicytus ramiflorus
YKNGTIP

SEQ ID NO: 6898 - protein, 7 aa, Melicytus ramiflorus
YKNGSIP

SEQ ID NO: 6899 - protein, 7 aa, Melicytus ramiflorus
YKNGSIP

SEQ ID NO: 6900 - protein, 7 aa, Viola odorata
TRNGLPV

SEQ ID NO: 6901 - protein, 7 aa, Viola odorata
SRNGLPV

SEQ ID NO: 6902 - protein, 7 aa, Viola odorata
TRNGVPI

SEQ ID NO: 6903 - protein, 7 aa, Viola odorata
TRNGLPI

SEQ ID NO: 6904 - protein, 7 aa, Viola odorata
TRNGLPI

SEQ ID NO: 6905 - protein, 7 aa, Viola odorata
TRNGVPI

SEQ ID NO: 6906 - protein, 7 aa, Viola odorata
SRNGVPV

SEQ ID NO: 6907 - protein, 7 aa, Viola odorata
SRNGLPV

SEQ ID NO: 6908 - protein, 7 aa, Viola hederacea
TRNGLPV

SEQ ID NO: 6909 - protein, 7 aa, Viola biflora
TRNGLPV

SEQ ID NO: 6910 - protein, 7 aa, Viola biflora
TRNGLPV

SEQ ID NO: 6911 - protein, 7 aa, Viola biflora
TRNGLPV

SEQ ID NO: 6912 - protein, 7 aa, Viola biflora
TRNGLPV

SEQ ID NO: 6913 - protein, 7 aa, Viola biflora
YKNGTIP

SEQ ID NO: 6914 - protein, 7 aa, Viola biflora
YKNGTFP

SEQ ID NO: 6915 - protein, 7 aa, Viola biflora
YKNGLLP

SEQ ID NO: 6916 - protein, 7 aa, Viola biflora
YKNGTFP

SEQ ID NO: 6917 - protein, 7 aa, Viola cotyledon
YYNGSIP

SEQ ID NO: 6918 - protein, 7 aa, Viola cotyledon
YYNGSIP

SEQ ID NO: 6919 - protein, 7 aa, Viola arvensis
  misc_feature (2)..(2): Xaa can be any naturally occurring amino acid
TXNGLPV

SEQ ID NO: 6920 - protein, 7 aa, Viola odorata
TRNGAPI

SEQ ID NO: 6921 - protein, 7 aa, Viola odorata
YRNGLPV

SEQ ID NO: 6922 - protein, 8 aa, Chassalia discolor
KRNGADGF

SEQ ID NO: 6923 - protein, 8 aa, Hybanthus floribundus E
MKNGSPIQ

SEQ ID NO: 6924 - protein, 8 aa, Hybanthus floribundus E
MKNGSPRQ

SEQ ID NO: 6925 - protein, 8 aa, Viola odorata
AKNGSIPA

SEQ ID NO: 6926 - protein, 8 aa, Oldenlandia affinis
TKDGSVLN

SEQ ID NO: 6927 - protein, 8 aa, Oldenlandia affinis
TKDGSVFN

SEQ ID NO: 6928 - protein, 8 aa, Oldenlandia affinis
TKDGSVFN

SEQ ID NO: 6929 - protein, 8 aa, Melcytus ramiflorus
TKNGSAIL

SEQ ID NO: 6930 - protein, 8 aa, Palicourea condensata
KRNGDPTF

SEQ ID NO: 6931 - protein, 10 aa, Viola yedoensis
YGTNGGTIFD

SEQ ID NO: 6932 - protein, 10 aa, Viola yedoensis
YGTNGGTIFD

SEQ ID NO: 6933 - protein, 10 aa, Viola yedoensis
YGTNGGTIFD

SEQ ID NO: 6934 - protein, 10 aa, Viola arvensis
YGTNGGTIFD

SEQ ID NO: 6935 - protein, 10 aa, Viola arvensis
YGENGGTIFD

We claim:

1. An isolated nucleic acid molecule encoding a proteinaceous molecule having a cystine knot backbone and a defined biological activity, comprising a sequence of nucleotides encoding a linear precursor form of a cyclic cystine knot polypeptide operably linked to a promoter, wherein said linear precursor form comprises an amino acid sequence comprising:

a signal peptide, a cystine knot polypeptide and a non-cystine knot polypeptide, wherein said cystine knot polypeptide in its mature form comprises the structure:

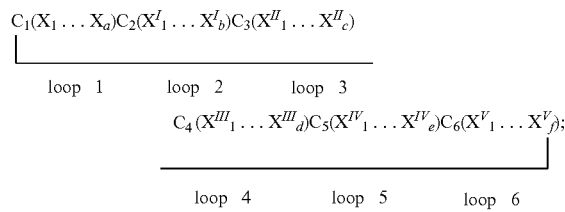

wherein $C_1$ to $C_6$ are cysteine residues;

wherein each of $C_1$ and $C_4$, $C_2$ and $C_5$, and $C_3$ and $C_6$ are connected by a disulfide bond to form a cystine knot;

wherein each X represents an amino acid residue in a loop, wherein said amino acid residues may be the same or different;

wherein a is any number from 3-10;

wherein d is 1-2;

wherein b, c, e, and f, may be the same or different, and may be any number from 1 to 20;

wherein one or two of loops 2, 3, 5 and 6 have an amino acid sequence comprising the sequence of a heterologous peptide comprising a plurality of contiguous amino acids and having a defined biological activity and wherein said heterologous peptide is about 2 to 30 amino acid residues, wherein the signal peptide has the amino acid sequence of SEQ ID NO:128, and wherein said non-cystine knot polypeptide comprises an albumin a-chain.

2. The isolated nucleic acid of claim 1, wherein said amino acid sequence of said heterologous peptide comprises a portion of an amino acid sequence of a larger protein, wherein said peptide confers said defined biological activity on said larger protein.

3. The isolated nucleic acid molecule of claim 1, wherein in said amino acid sequence of said precursor form, said signal peptide is adjacent to the N-terminal amino acid of the mature form of said cystine knot polypeptide.

4. A method for producing a cystine knot polypeptide, comprising: transforming a host cell with a vector comprising the nucleic acid molecule of claim 1, wherein said precursor form of said cystine knot polypeptide is expressed.

5. A method for producing a cyclic cystine knot polypeptide, comprising:

i) transforming a host cell with a vector comprising the isolated nucleic acid molecule according to claim 1, ii) expressing a linear precursor form of a cystine knot polypeptide; and iii) processing said linear precursor form to form a cyclic cystine knot polypeptide having the structure:

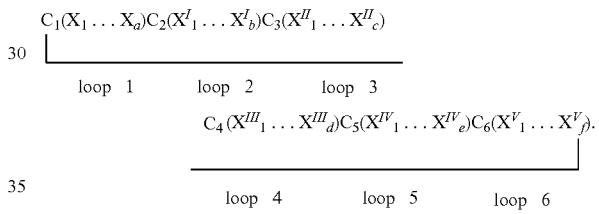

6. The method of claim 5, wherein said host cell is a plant cell.

7. The method of claim 6, wherein said plant cell is from the plant family Fabaceae.

8. The method of claim 4, wherein said host cell carries an enzyme for processing said precursor form of said cystine knot polypeptide to produce a cyclic cystine knot polypeptide.

9. The method of claim 5, wherein said host cell carries an enzyme for processing said precursor form of said cystine knot polypeptide to produce a cyclic cystine knot polypeptide.

10. A composition comprising a host cell comprising a heterologous nucleic acid comprising the isolated nucleic acid of claim 1.

11. The isolated nucleic acid of claim 1, wherein in the cyclic form of said cystine knot polypeptide, loop 6 has an amino acid sequence selected from the group consisting of YRNGVIP (SEQ ID NO: 110), YLNGVIP (SEQ ID NO: 111), YLDGVP (SEQ ID NO: 112), YLNGIP (SEQ ID NO: 113), YLDGIP (SEQ ID NO: 114), YLNGLP (SEQ ID NO: 115), YNNGLP (SEQ ID NO: 116), YNDGLP (SEQ ID NO: 117), YINGTVP (SEQ ID NO: 118), YIDGTVP (SEQ ID NO: 119), YNHEP (SEQ ID NO: 120), YDHEP (SEQ ID NO: 121), LKNGSAF (SEQ ID NO: 122), MKNGLP (SEQ ID NO: 123), YRNGIP (SEQ ID NO: 124), YKNGIP (SEQ ID NO: 125), and YRDGVIP (SEQ ID NO: 126).

* * * * *